(12) United States Patent
Kralovics et al.

(10) Patent No.: US 9,371,570 B2
(45) Date of Patent: Jun. 21, 2016

(54) MUTANT CALRETICULIN FOR THE DIAGNOSIS OF MYELOID MALIGNANCIES

(71) Applicant: CeMM—FORSCHUNGSZENTRUM FÜR MOLEKULARE MEDIZIN GmbH, Vienna (AT)

(72) Inventors: Robert Kralovics, Vienna (AT); Thorsten Klampfl, Cambridge (GB); Heinz Gisslinger, Vienna (AT)

(73) Assignee: CeMM—FORSCHUNGSZENTRUM FÜR MOLEKULARE MEDIZIN GmbH, Vienna (AT)

( * ) Notice: Subject to any disclaimer, the term of this patent is extended or adjusted under 35 U.S.C. 154(b) by 0 days.

(21) Appl. No.: 14/486,973

(22) Filed: Sep. 15, 2014

(65) Prior Publication Data

US 2015/0079091 A1    Mar. 19, 2015

Related U.S. Application Data

(60) Provisional application No. 61/909,313, filed on Nov. 26, 2013.

(30) Foreign Application Priority Data

Sep. 16, 2013  (EP) ..................... 13184632
Oct. 1, 2013   (EP) ..................... 13186939

(51) Int. Cl.
 G01N 33/53   (2006.01)
 C12Q 1/68    (2006.01)
 G01N 33/574  (2006.01)

(52) U.S. Cl.
 CPC ........ *C12Q 1/6886* (2013.01); *G01N 33/57426* (2013.01); *C12Q 2600/156* (2013.01); *G01N 2333/47* (2013.01)

(58) Field of Classification Search
 None
 See application file for complete search history.

(56) References Cited

PUBLICATIONS

Nabi et al (Am J Med Genet B Neuropsychiatr Genet, 2010, 153B(2):706-709).*
Lee et al (Blood Cells, Molecules, and Diseases, 2002, 29(3): 471-487).*

* cited by examiner

*Primary Examiner* — Sean Aeder
(74) *Attorney, Agent, or Firm* — Foley & Lardner LLP

(57) ABSTRACT

Mutations in calreticulin are discovered to be linked to myeloid malignancies. Disclosed are genomic sequences, cDNA sequences, mRNA sequences and protein sequences of mutant calreticulin that are linked to myeloid malignancies. Also disclosed are methods for diagnosing myeloid malignancy comprising determining the presence of a mutant allele of the calreticulin gene. Also disclosed are related compositions, kits and methods, including the medical use of inhibitors of mutant calreticulin.

30 Claims, 17 Drawing Sheets

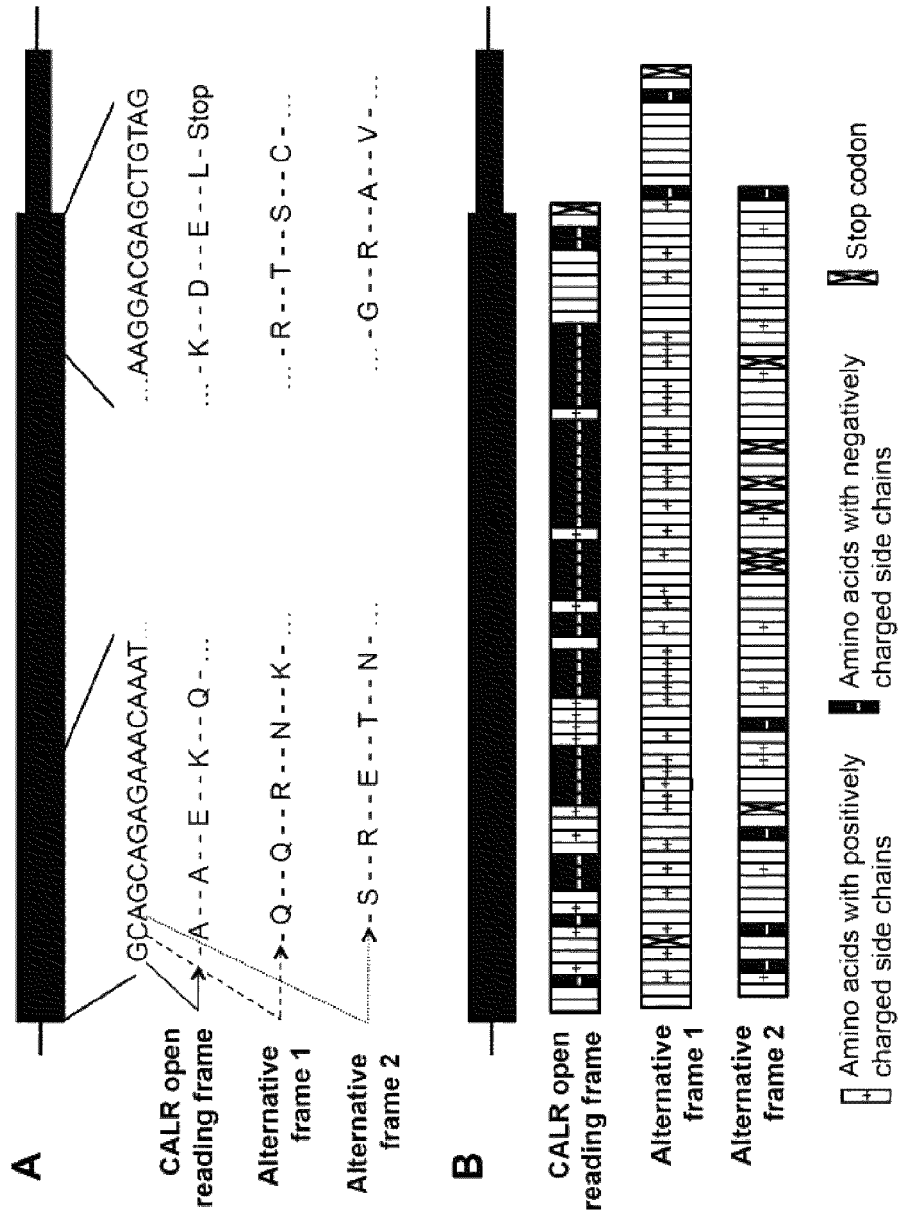
FIGURES 3A-B

MUTANT CALRETICULIN FOR THE DIAGNOSIS OF MYELOID MALIGNANCIES

CROSS REFERENCE TO RELATED APPLICATIONS

This application claims benefit of the filing date of U.S. provisional application No. 61/909,313, filed 26 Nov. 2013; European application No. EP 13 18 4632.1, filed 16 Sep. 2013; and European application No. EP 13 18 6939.8, filed 1 Oct. 2013.

SEQUENCE LISTING

The instant application contains a Sequence Listing which has been submitted electronically in ASCII format and is hereby incorporated by reference in its entirety. Said ASCII copy, created on Sep. 8, 2014, is named 028622-0287_SL.txt and is 870,688 bytes in size.

FIELD OF THE INVENTION

The present invention relates to a method for diagnosing a myeloid malignancy comprising determining the presence of a mutant allele of the calreticulin gene. Also genomic sequences, cDNA sequences, mRNA sequences and protein sequences of the mutant calreticulin are subject of the present invention. Further, the invention relates to medical uses of inhibitors of mutant calreticulin.

BACKGROUND

Primary myelofibrosis (PMF), essential thrombocythemia (ET) and polycythemia vera (PV) are monoclonal hematological disorders that belong to the classical BCR-ABL negative myeloproliferative neoplasms (MPN) (Campbell & Green, 2006). Since the 2005 discovery of a somatic mutation in the JAK2 kinase gene, a tremendous progress has been made in molecular diagnosis, clinical management, treatment and molecular understanding of MPN. The valine to phenylalanine (V617F) mutation constitutively activates the Jak2 kinase resulting in increased phosphorylation of its substrates (Stat5, Stat3, Erk, etc.) and leading to increased cytokine responsiveness of myeloid cells (Baxter et al, 2005; James et al, 2005; Kralovics et al, 2005; Levine et al, 2005). Identification of additional mutations soon followed such as in JAK2 exon 12 in PV (Scott et al, 2007) and in the thrombopoietin receptor gene MPL in PMF and ET (Pardanani et al, 2006; Pikman et al, 2006). Although the three MPN disease entities differ in their clinical presentation, they share many molecular as well as clinical features. The JAK2-V617F mutation is present in about 95% of PV cases, 60% PMF and 50% of ET cases, respectively. Mutations in JAK2 exon 12 are specific to about 3% of PV cases whereas MPL mutations are restricted to the PMF (5%) and ET (3%). All three MPN entities are predisposed at a variable degree to thrombosis, bleeding and leukemic transformation (Sverdlow et al, 2008). Although patients may remain in the chronic phase of MPN for several years, disease progression occurs in a form of secondary myelofibrosis in PV and ET, development of accelerated phase with variable degree of pancytopenia followed by leukemic transformation affecting all three MPN entities (Sverdlow et al, 2008).

Somatic mutations accumulate during the entire clonal evolution of MPN hematopoietic stem cells. These acquired genetic alterations may be point mutations, chromosomal lesions and epigenetic defects and they all may contribute to the fitness of the evolving clone (Klampfl et al, 2011; Kralovics, 2008). These mutations may accelerate proliferation by various means, decrease differentiation potential of progenitors or render them less susceptible to apoptosis. Mutations affecting these mechanisms have been described in genes such as TET2 (Delhommeau et al, 2009), EZH2 (Ernst et al, 2010), DNMT3A (Stegelmann et al, 2011), ASXL1 (Stein et al, 2011), and TP53 (Harutyunyan et al, 2011) in different types of myeloid malignancies including MPN (Milosevic & Kralovics, 2013). However, so far only JAK2 and MPL mutations are considered strongly MPN associated and they represent the most useful molecular markers of MPN.

Despite the progress made in the understanding of the molecular pathogenesis of MPN approximately half of the patients with PMF and ET lack a molecular marker for diagnosis as these patients are negative for both JAK2 and MPL mutations.

Thus, the technical problem underlying the present invention is the provision of means and methods for diagnosis of a myeloid malignancy.

SUMMARY OF THE INVENTION

Accordingly, the present invention relates to a method for assessing whether a patient suffers from a myeloid malignancy or is prone to suffering from a myeloid malignancy, said method comprising
 determining the presence of one or more mutant alleles of the calreticulin gene in a sample from said patient; and
 assessing that said patient suffers from a myeloid malignancy or is prone to suffering from a myeloid malignancy when said one or more mutant alleles of the calreticulin gene is present.

The technical problem is solved by provision of the embodiments characterized in the claims.

BRIEF DESCRIPTION OF THE DRAWINGS

FIG. 1 shows SEQ ID NOs: 1324 to 1327.

2A: Distribution of JAK2, MPL and CALR mutations in the three classical MPN disease entities.

2B: The frequency of patients with mutant CALR in different myeloid malignancies, is indicated by the dark bars. N, total numbers of patients analysed for a specific disease entity.

2C: Distribution of JAK2, MPL, CALR and SF3B1 mutations in 24 patients with refractory anemia with ring sideroblasts associated with marked thrombocytosis. PV, polycythemia vera; ET, essential thrombocythemia; PMF primary myelofibrosis; dnAML, de novo AML: CML, chronic myeloid leukaemia; MDS, myelodysplastic syndrome; CMML, chronic myelomonocytic leukaemia; RARS-T, refractory anemia with ring sideroblasts associated with marked thrombocytosis.

FIGS. 3A-E. Mutational pattern of CALR mutations in MPN patients.

The wide black bar represents exon 9 of CALR, the narrow bar the 3' UTR of the gene, the thin line intronic and intergenic regions.

3A: indicated are the cDNA sequence in the beginning and end of exon 9. Below the cDNA sequence are the amino acid sequences derived from the three alternative reading frames. FIG. 3A discloses SEQ ID NOS 1328-1335, respectively, in order of appearance.

3B: The three reading frames result in different peptide compositions, especially with respect to the charge of amino acids.

Figure 3C:
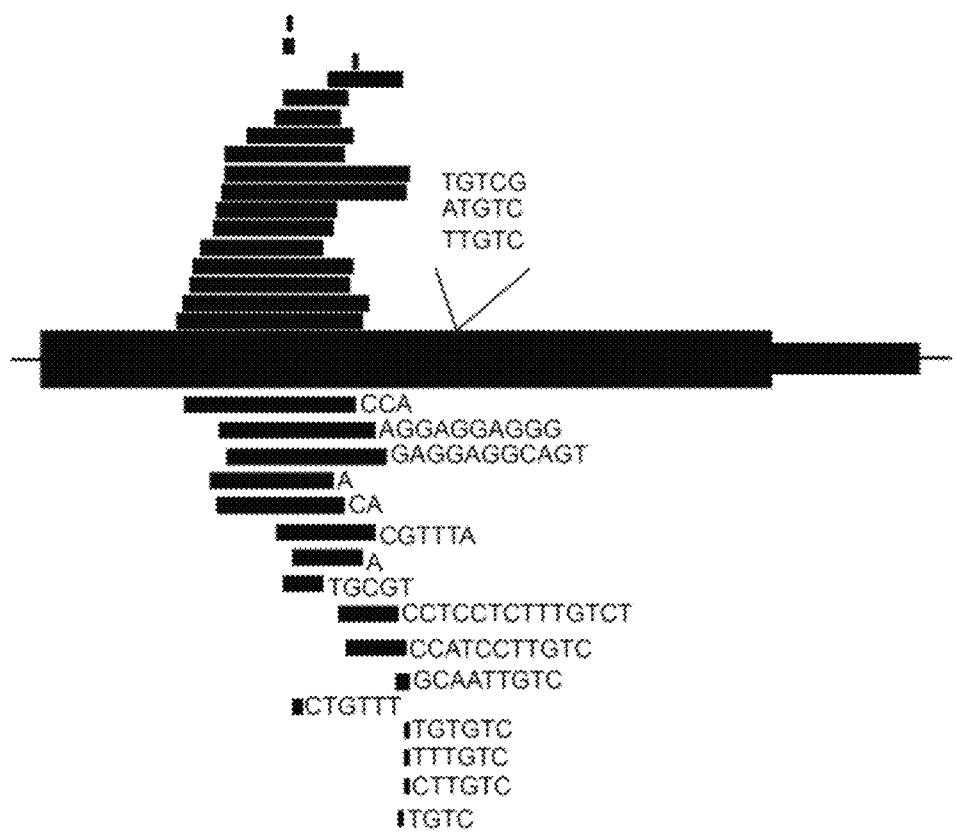

3C: Summary of all mutations detected in MPN patients and their position within CALR exon 9. Bars indicate deletion events, letters inserted sequences. Independent insertions and deletions are depicted above the exon 9 scheme, combined insertion/deletion events below. FIG. 3C discloses SEQ ID NOS 1336-1339, respectively, in order of appearance.

3D: The specific peptide makeup of wild type CALR and of the two most frequently detected types of mutations. B, D: Each box represents an amino acid. Black boxes with '−' sign are negatively charged amino acids, boxes with '+' sign are positively charged amino acids. Crossed boxes represent stop codons.

3E: Relative frequencies of all 36 mutation types observed in CALR.

Figure 4A:
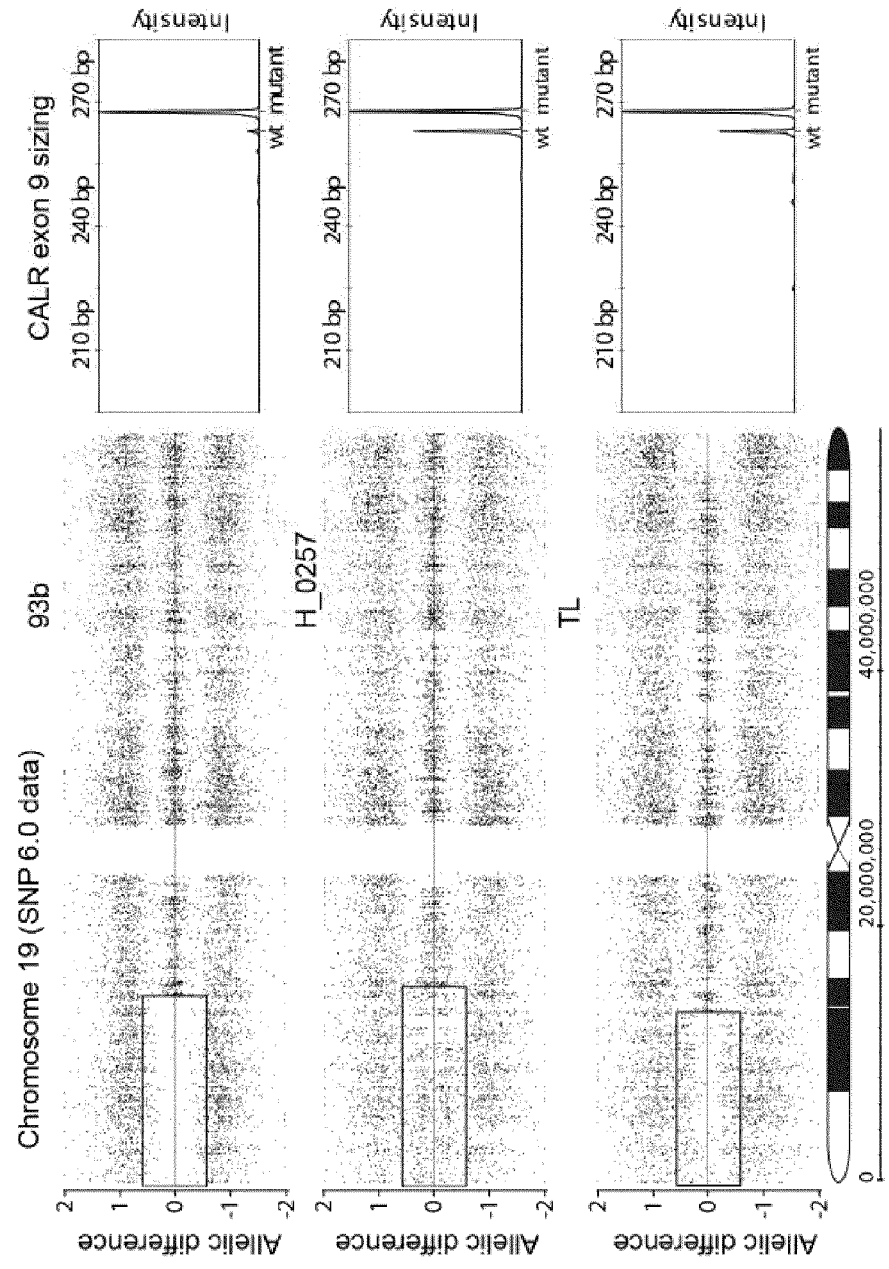
Figure 4B:
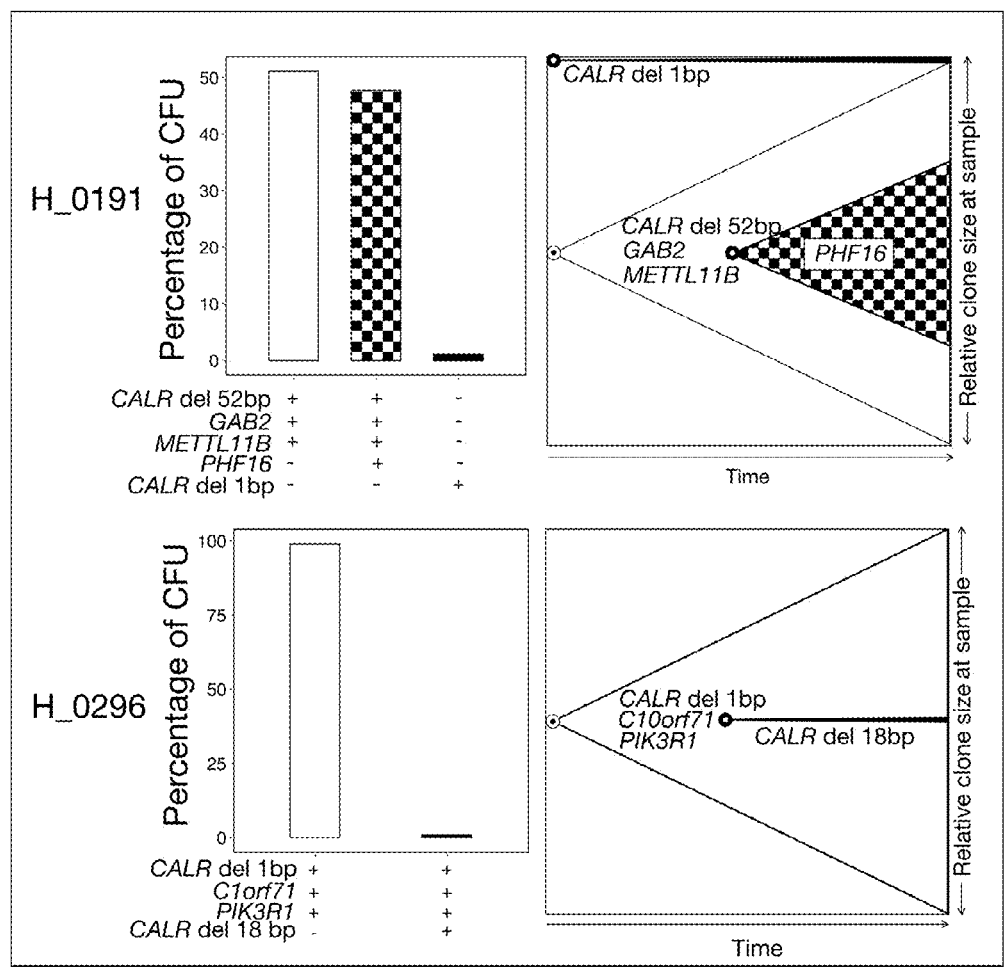

FIGS. 4A-B: Association of CALR mutations with uniparental disomies and clonal hierarchies in patients with multiple somatic mutations.

4A: Affymetrix SNP 6.0 array data is shown for three samples that had more than 50% burden of CALR mutations. Each dot represents a single SNP. The x-axis shows the genomic position, the y-axis depicts the allelic status of the SNP. (heterozygous status=allelic difference of 0). The array data shows 19p uniparental disomy of different sizes in the three samples. Boxes indicate the genomic region of the uniparental disomies. To the right of each allelic difference plot, the results of the CALR exon 9 fragment analysis for the same sample is shown. In each case the burden of the mutant allele is higher than the wild type allele burden.

4B: Clonal hierarchies derived from the analysis of hematopoietic progenitor colonies. Patient H_0191 (top) harbored somatic mutations in a total of 4 genes. As shown in the bar chart, 51% of the colonies had mutations in CALR, GAB2 and METTL11B. The other half of the colonies (48%) had mutations in all four genes indicating that the mutation in PHF16 was acquired later and gave rise to a subclone. Additionally, one colony harbored a one base pair deletion in CALR, different from the 52 base pair deletion that was observed in the granulocyte sample and all other colonies of this patient. As this colony had none of the other mutations observed in the patient it represents an independent clone although this conclusion is based only on a single colony. Patient H_0296 (bottom) had somatic mutations in CALR, PIK3R1 and C10ORF71. All colonies analyzed for this patient had all three mutations. One colony showed an 18 base pair deletion in CALR in addition to the 1 base pair deletion observed in this patient. Both mutations were on the same allele.

Figure 5A:
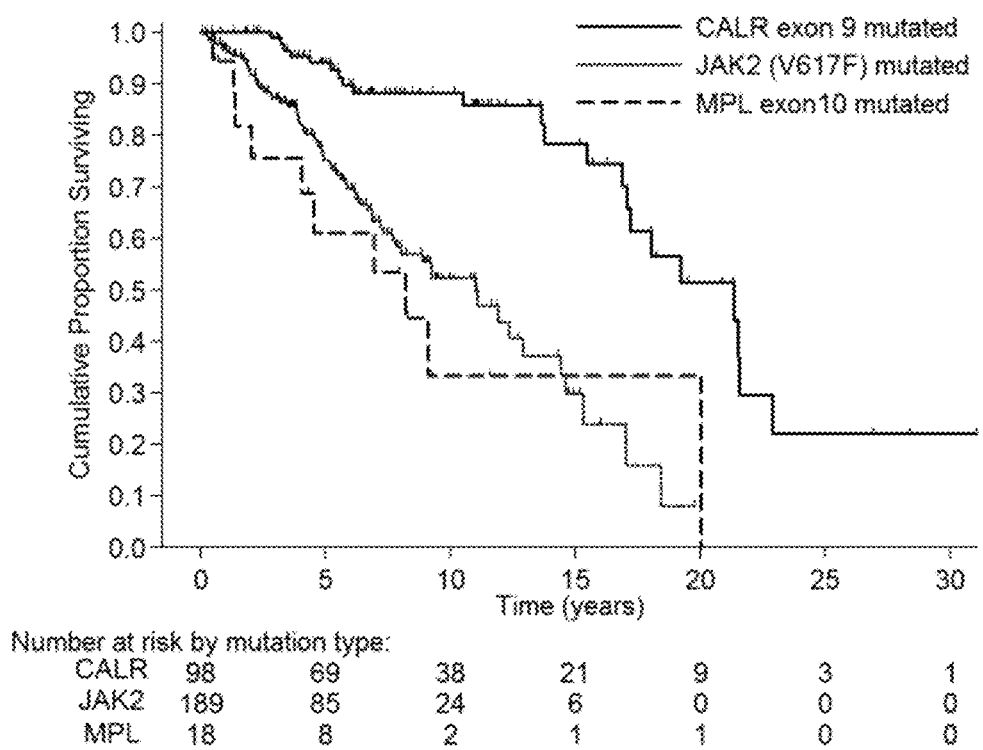
Figure 5B:
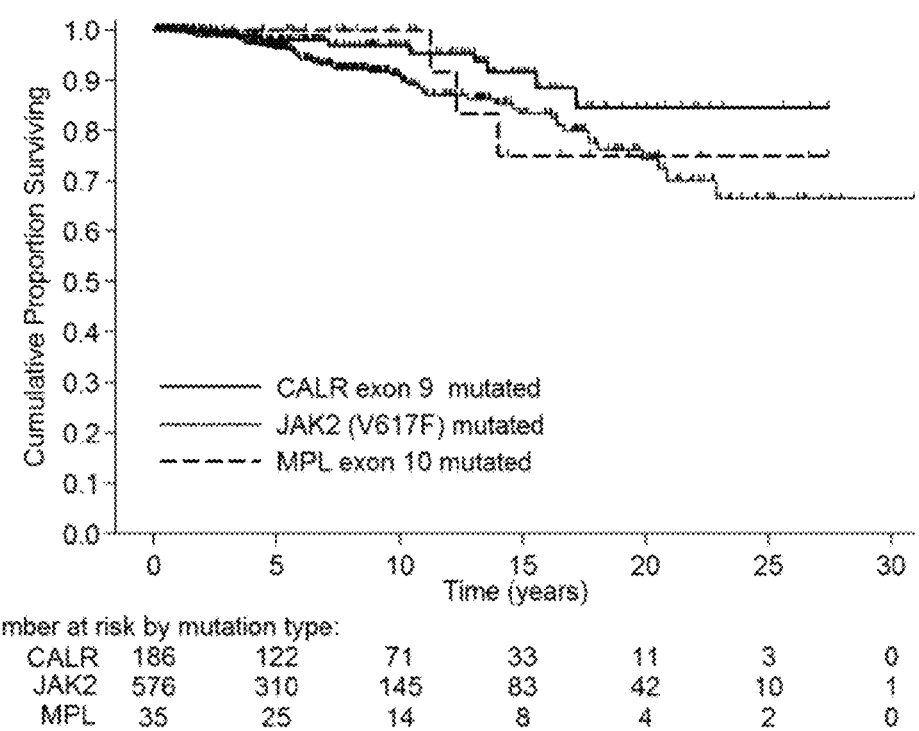
Figure 5C:
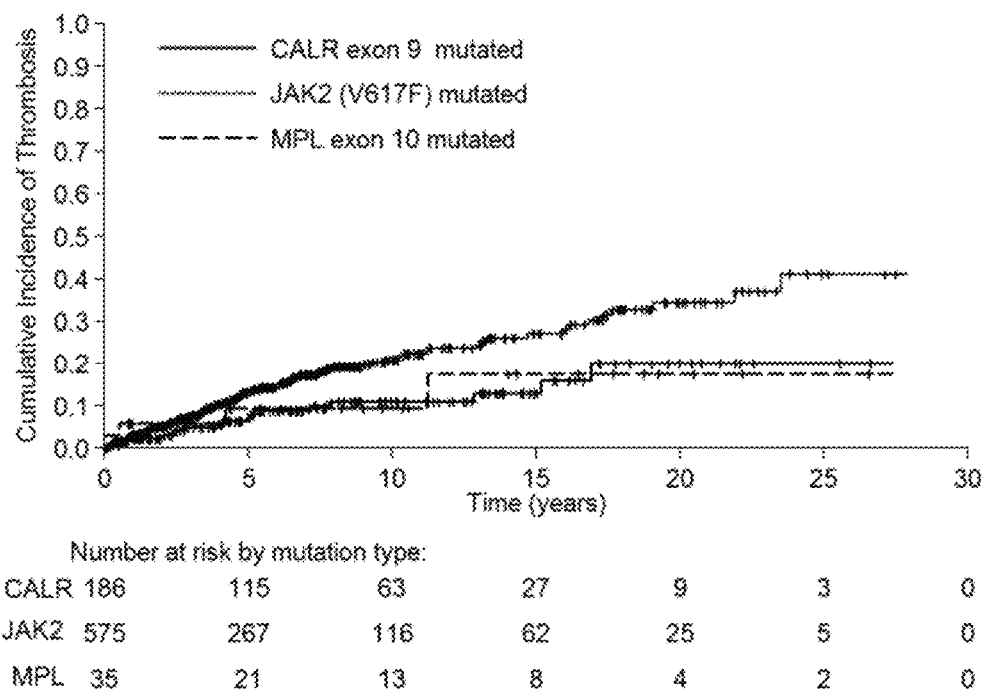

FIGS. 5A-C: Clinical significance of CALR mutations.

Outcome estimates in patients with essential thrombocythemia or primary myelofibrosis stratified according to their somatic mutation.

5A: Kaplan-Meier analysis of overall survival in patients with primary myelofibrosis. Subgroups were compared using the log-rank test. Patients with myelofibrosis carrying a somatic mutation of CALR had a better overall survival than those with JAK2-V617F [median value 21.4 years (95% CI, 17.1-22.9) vs. 11.0 years (95% CI, 7.8-14.4), respectively; P<0.001] or MPL mutation [median value 8.2 years (95% CI, 2.0-not reached); P<0.001], while no difference was observed between the latter 2 subgroups.

5B: Kaplan-Meier analysis of overall survival in patients with essential thrombocythemia. Subgroups were compared using the log-rank test. Median value for overall survival was not reached in any subgroup. Patients with CALR mutation had better overall survival compared with those carrying JAK2-V617F. The 10-year overall survival was 96.9% (95% CI, 91.7-98.8%) in the former vs. 91.1% (95% CI, 87.1-93.9%) in the latter (P=0.043).

5C: Cumulative incidence of thrombosis in patients with essential thrombocythemia. Death in absence of the event of interest was considered as a competing event, and subgroups were compared with the Pepe and Mori's test. Patients carrying a CALR exon 9 mutation had a lower cumulative incidence of thrombosis compared with those carrying JAK2-V617F: the 10-year cumulative incidence was 11.0% (95% CI, 6.3-17.1%) in the former vs. 21.0% (95% CI, 16.6-25.7%) in the latter (P=0.003).

FIGS. 6A-D: Functional analysis of CALR type 1 mutation.

6A: Cell viability of Ba/F3 cells expressing an empty vector (GFP), wild type CALR (CALR wt-GFP) or mutant CALR (CALR del52-GFP) was assessed after 72 hours in presence of increasing interleukin-3 concentration. RLU, relative luminescence units. Error bars represent standard error of the mean.

6B: Cell proliferation of Ba/F3 cells expressing an empty vector (GFP), wild type CALR (CALR wt-GFP) or mutant CALR (CALR del52-GFP), in the absence of interleukin-3 was determined for 7 days, Error bars represent standard error of the mean.

6C: shows the activation of STAT5 in response to interleukin-3. Ba/F3 cells expressing the empty vector (GFP), the wild type CALR (wt), or the CALR mutant (del52) were starved for 4 hours in serum free medium without interleukin-3 and were then stimulated for 20 minutes with 100 pg/ml and 1 ng/ml of interleukin-3, as indicated. Western blot was performed on the cell lysates with antibodies against pYS-TAT5, STAT5, and CALR. An antibody against GAPDH was used as loading control.

6D: Immunofluorescence was performed against CALR (third panel) and an endoplasmic reticulum specific marker (Calnexin, second panel), in HEK293T transfected with the respective constructs. The wild type CALR co-localizes with calnexin, in the endoplasmic reticulum (last panel). However, the mutant CALR is not constrained within the endoplasmic reticulum. The nucleus is stained with the dye DAPI (first panel).

Figure 7:
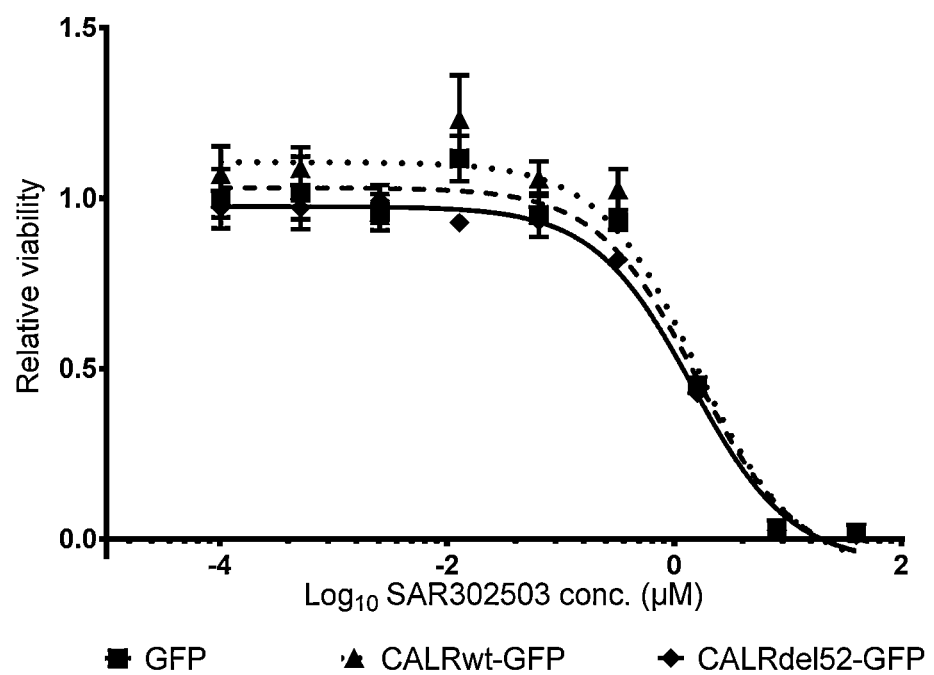

FIG. 7: The sensitivity of Ba/F3 cells to SAR302503. Ba/F3 cells expressing the empty vector (GFP), CALR wild type (CALR wt-GFP) or CALR mutant (CALR del52-GFP) were analyzed by defining cell viability after 48 hours in presence of decreasing SAR302503. For relative viability, relative luminescence units were normalized to the DMSO control. Error bars represent standard error of the mean.

DETAILED DESCRIPTION

Specific Calreticulin Mutations are Associated with Myeloid Malignancies

The present invention solves the above identified technical problem since, as documented herein below and in the appended examples, it was surprisingly found that patients suffering from a myeloid malignancy, preferably primary myelofibrosis (PMF) and essential thrombocythemia (ET), have somatic mutations in the calreticulin (CALR) gene.

Another surprising finding was that these myeloid cell specific somatic mutations in the CALR gene in patients with MPN strongly associate with those patients that are negative for both JAK2 and MPL mutations (the previously described disease causing mutations in MPN). As shown herein, CALR mutations are found in 88% of PMF cases, and in 68% of ET cases double negative for JAK2 and MPL. Thus, the present invention provides a reliable diagnosis of myeloid malignancies. The invention is especially useful for patients for which no reliable markers exist, such as patients which are negative for JAK2 and MPL mutations.

Moreover, it was found herein that the herein provided somatic mutations in the calreticulin (CALR) gene result in a C-terminus of the calreticulin protein which has completely different characteristics compared with the wild type calreticulin protein. It is believed that these different characteristics cause or contribute to the development of myeloid malignancy, preferably primary myelofibrosis (PMF) and essential thrombocytemia (ET).

All the mutations of CALR identified herein are in the last exon 9 encoding the C-terminal amino acids of the protein and are predominantly insertion/deletion mutations. The majority of the mutations were present in a heterozygous state and they cause a frameshift to an alternative reading frame (alternative frame 1 as shown in FIG. 3A). This frameshift results in the replacement of the C-terminal negatively charged amino acids (aspartic and glutamic acid rich) of calreticulin by a predominantly positively charged polypeptide rich in arginine and methionine. In addition, the last 4 amino acids of calreticulin (KDEL (SEQ ID NO: 1331)) contain the endoplasmatic reticulum retention signal. This signal is absent in the mutant calreticulin suggesting that the mutant protein is less represented in the ER compared to the wild type protein. As the negatively charged C-terminus of calreticulin is a low affinity high capacity Ca2+ binding domain, it is believed that the Ca2+ binding function of the mutant protein is lost. It has been demonstrated herein that the predominant mutations of CALR are type 1 and type 2 mutations as defined herein; see FIG. 3E. These mutants and their use in accordance with the present invention is therefore preferred. Nucleic acid sequences encoding the C-terminus and the amino acid sequence of the C-terminus of type 1 and type 2 CALR mutations are shown in SEQ ID NO: 5 to 12. Further nucleic acids of type 1 and type 2 CALR mutations are disclosed herein.

The present invention relates to the following items:
Detection of CALR Mutations for Diagnosis of Myeloid Malignancy As used herein "diagnosis" refers to the identification of a physiological or pathophysiological problem underlying a symptom. Thus "diagnosis of a myeloid malignancy" refers to determining (a) if a patient has a myeloid malignancy and/or (b) what type(s) of myeloid malignancy and/or (c) features of the specific myeloid malignancy. Diagnosis can be performed e.g. based on examination of symptoms and/or complementary tests (e.g. cytogenetic or molecular tests).

The term "assessing whether a patient suffers from a myeloid malignancy" and "diagnosing myeloid malignancy" can be used interchangeably herein. The diagnosis can also comprise or relate to the assessment whether a patient is prone to suffering from a myeloid malignancy, i.e. whether the patient is at risk of developing a myeloid malignancy.

The detection of the herein provided CALR mutations at the level of genomic DNA, RNA, cDNA and protein is useful for the diagnosis of a myeloid malignancy: whether a patient has a myeloid malignancy, what type myeloid malignancy, and specific features of the disease.

The present invention relates to a method for assessing whether a patient suffers from a myeloid malignancy or is prone to suffering from a myeloid malignancy, said method comprising
  determining the presence of one or more mutant alleles of the calreticulin gene in a sample from said patient; and
  assessing that said patient suffers from a myeloid malignancy or is prone to suffering from a myeloid malignancy when said one or more mutant alleles of the calreticulin gene is present.

The methods provided herein can comprise a step of obtaining a sample from the patient. "Obtained" encompasses receipt of a sample that is provided by a third party. For example, blood may be drawn from a patient, placed in appropriate receptacle, and then provided for analysis.

The present invention relates to a method for assessing whether a patient suffers from a myeloid malignancy or is prone to suffering from a myeloid malignancy, said method comprising
  obtaining a sample from said patient;
  determining the presence of one or more mutant alleles of the calreticulin gene in a sample from said patient; and
  assessing that said patient suffers from a myeloid malignancy or is prone to suffering from a myeloid malignancy when said one or more mutant alleles of the calreticulin gene is present.

In accordance with the present invention, a patient is assessed "positive" for a myeloid malignancy, if one or more mutant alleles of the calreticulin gene are present in a sample, preferably a blood sample, from said patient.

The term "myeloid malignancy" as used herein refers to clonal haematological diseases affecting the myeloid blood lineages including those with chronic and those with acute clinical course. Myeloid malignancies include myeloproliferative neoplasms, myelodysplastic syndromes and acute myeloid leukemias. It is preferred herein that the myeloid malignancy is a myeloproliferative neoplasm, particularly primary myelofibrosis (PMF) or essential thrombocythemia (ET), or a myelodysplastic syndrome, particularly refractory anemia with ringed sideroblasts and thrombocythemia (RARS-T).

Thus, the diagnosis of myeloid malignancy can be tp further diagnose subtypes of disease. In further embodiments, the diagnosis utilizes additional tests in combination, such as blood chemistry, cytology, and genetic analysis. Depending on the nature of the myeloproliferative neoplasm, additional diagnostic tests may include red cell mass determination (for polycythemia), bone marrow aspirate and trephine biopsy, arterial oxygen saturation and carboxyhaemoglobin level, neutrophil alkaline phosphatase level, vitamin B12 (or B12 binding capacity) and serum urate. Genetic tests have proven to be increasingly important in diagnosis.

The following tests are traditionally done to diagnose the following diseases. See e.g. Vardiman, et al. (2009). "The 2008 revision of the World Health Organization (WHO) classification of myeloid neoplasms and acute leukemia: Rationale and important changes". *Blood* 114 (5): 937-51.

Chronic Myelogenous Leukemia (CML)
  With defining translocation t(9;22); Philadelphia chromosome, BCR-ABL translocation which has three breakpoints:
    u-BCR-ABL (p230): leads to CML with usual neutrophilia and basophilia
    minor-BCR-ABL (p190): leads to CML which has a tendency to become acute lymphoblastic leukemia (ALL) usually precursor B ALL and rarely precursor T ALL
    major-BCR-ABL (p210): normal usual breakpoint Essential Thrombocythemia (ET)

ET is associated with the JAK2V617F mutation in up to 55% of cases and with an MPL (thrombopoietin receptor) mutation in up to 5% of cases:

Cellular phase—increased large megakaryocytes with fibrosis and little increase in other bone marrow elements Fibrotic phase—collagenous fibrosis with lack of marrow elements These disorders are still being revised according to more specific genetic mutations and how often patients end in a fibrotic marrow event.

Polycythemia Vera (PV)

PV is associated most often with the JAK2V617F mutation in greater than 95% of cases, whereas the remainder have a JAK2 exon 12 mutation:

Cellular phase—increased megakaryocytes which cluster, reticulin fibrosis, later trichrome fibrosis, and increased myeloid and erythroid precursors Fibrotic phase—collagenous fibrosis with lack of marrow elements Primary Myelofibrosis (PMF)

PMF is associated with the JAK2V617F mutation in up to 50% of cases, the JAK2 exon 12 mutations in 1-2% of cases, and the MPL (thrombopoietin receptor) mutation in up to 5% of cases:

Cellular phase—increased megakaryocytes which cluster, reticulin fibrosis, later trichrome (collagenous) fibrosis, and increased myeloid precursors Fibrotic phase—collagenous fibrosis with lack of marrow elements Refractory anemia with ring sideroblasts associated with marked thrombocytosis (RARS-T) is often considered a myeloid malignancy. Diagnosis of RARS-T may traditionally involve hematology and cytology, analysis of bone marrow, and lack of karyotype abnormalities such as del (5q), t(3;3)(q21;q26) or inv(3)(q21;q26). See Broseus et al., "Clinical features and course of refractory anemia with ring sideroblast associated with marked thrombocytosis" *Haematologica* 9(7): 1036-1041 (2012).

While the type of myeloid malignancy guides diagnosis and treatment, individual malignancies may have specific mutations that further determine the prognosis and course of treatment. Genetic markers are particularly useful because they often illuminate the underlying pathogenesis of the disease. The determination of the presence of one (or more) mutant alleles of the calreticulin gene or of a gene product thereof as described herein can be performed as a stand-alone analysis. Alternatively, this analysis can be followed or preceded by the analysis of other markers for myeloid malignancies, such as JAK2 and MPL mutations. For example, patients suspected to suffer from a myeloid malignancy, such as a myeloproliferative neoplasm (and in particular primary myelofibrosis (PMF) or essential thrombocythemia (ET)), can be tested first for a JAK2 mutation (in particular the V617F mutation). If they are tested negative for the JAK2 mutation they can be tested for mutant calreticulin. If they are then tested negative for mutant calreticulin, they can be tested for MPL mutations, e.g. mutations in exon 10 of the mpl gene. Of course, further markers can also be tested. Also different orders or modes of testing JAK2 mutations, mutant calreticulin and/or MPL mutations and, optionally, further markers are envisaged herein. For example, a positive JAK2 mutation test can be followed by a test for mutant calreticulin (and vice versa) for further diagnosis or prognostic assessment of the myeloid malignancy. Also simultaneous determination of such markers is envisaged, like the simultaneous test for JAK2 mutation(s) and mutant calreticulin (and, optionally, further markers), or the simultaneous test of JAK2 mutation(s), mutant calreticulin and MPL mutation(s) (and, optionally, further markers).

Preferably, the patients (or a sample from the patients) suffering from a myeloid malignancy or being prone to suffering from a myeloid malignancy are negative for both JAK2 and MPL mutations, i.e. mutations of JAK2 and MPL are absent in patients assessed to suffer from a myeloid malignancy or being prone to suffering from a myeloid malignancy in accordance with the present invention. In other words, the patients (or a sample from the patients) assessed to suffer from a myeloid malignancy or being prone to suffering from a myeloid malignancy in accordance with the present invention have preferably wild-type JAK2 and MPL present. For further diagnosis, the use of further markers/tests is envisaged. For example, routine bone marrow testing can be used. Such further markers/testing, like bone marrow testing, may be used to validate e.g. a positive mutant calreticulin test or may follow e.g. a negative mutant calreticulin test.

Wild-type nucleic acid sequences and amino acid sequences of JAK2 and MPL are known and can be deduced from the respective databases, such as NCBI. Exemplary nucleic acid sequences and amino acid sequences of wild-type JAK2 are shown in NM_004972.3 (JAK2 cDNA) and NP_004963.1 (JAK2 protein), respectively. Exemplary nucleic acid sequences and amino acid sequences of wild-type MPL are shown in NM_005373.2 (MPL cDNA) and NP_005364.1 (MPL protein).

Mutations of JAK2 and MPL in myeloid malignancies have been described herein above. Such mutations are, for example, the V617F mutation of JAK2 (valine to phenylalanine mutation at position 617 of the amino acid sequence of JAK2), mutations in exon 12 of the nucleic acid sequence encoding JAK2 and/or mutations in exon 10 of MPL.

The valine to phenylalanine (V617F) mutation is disclosed in Baxter et al, 2005; James et al, 2005; Kralovics et al, 2005; Levine et al, 2005). Mutations in JAK2 exon 12 in PV and in the thrombopoietin receptor gene MPL in PMF and ET have been disclosed in Scott et al, 2007 and in Pardanani et al, 2006; Pikman et al, 2006, respectively. All these references are incorporated herein by reference in their entirety.

The presence of JAK2 and MPL mutations can be excluded by allele specific PCR for JAK2-V617F(ref) and by Sanger sequencing of exon 12 of JAK2 and exon 10 of MPL. An exemplary protocol that can be used in this context is disclosed in Kralovics R, Teo S S, Li S, Theocharides A, Buser A S, Tichelli A, Skoda R C. Acquisition of the V617F mutation of JAK2 is a late genetic event in a subset of patients with myeloproliferative disorders. Blood. 2006 Aug. 15; 108(4): 1377-80. Epub 2006 May 4, which is incorporated herein by reference.

Accordingly, the present invention provides a novel myeloid malignancy patient group which is assessed to be positive for mutant calreticulin and negative for mutant JAK2 and mutant MPL (or, in other words, the novel myeloid malignancy patient group is assessed to be positive for mutant calreticulin and positive for wild-type JAK2 and wild-type MPL).

In a preferred embodiment, the methods of the present invention comprise
 a step of determining the presence of a wild type JAK2 protein or a wild type JAK2 nucleic acid in a sample from the patient; and/or
 a step of determining the presence of a wild type MPL protein or a wild type MPL nucleic acid in a sample from the patient.

In a particularly preferred embodiment, the methods of the present invention comprise
- a step of determining the presence of a wild type JAK2 protein or a wild type JAK2 nucleic acid in a sample from the patient; and
- a step of determining the presence of a wild type MPL protein or a wild type MPL nucleic acid in a sample from the patient.

The above steps of determining the presence of a wild type JAK2 protein or a wild type JAK2 nucleic acid in a sample from the patient; and/or determining the presence of a wild type MPL protein or a wild type MPL nucleic acid in a sample from the patient can be performed prior to or after the step of determining the presence of one or more mutant alleles of the calreticulin gene in a sample from said patient as provided and defined herein.

The present invention relates to a method for assessing whether a patient suffers from a myeloid malignancy or is prone to suffering from a myeloid malignancy, said method comprising
- determining the presence of one or more mutant alleles of the calreticulin gene in a sample from said patient;
- determining the presence of a wild type JAK2 protein or a wild type JAK2 nucleic acid in a sample from the patient; and
- assessing that said patient suffers from a myeloid malignancy or is prone to suffering from a myeloid malignancy when said one or more mutant alleles of the calreticulin gene is present.

The present invention relates to a method for assessing whether a patient suffers from a myeloid malignancy or is prone to suffering from a myeloid malignancy, said method comprising
- determining the presence of one or more mutant alleles of the calreticulin gene in a sample from said patient;
- determining the presence of a wild type MPL protein or a wild type MPL nucleic acid in a sample from said patient; and
- assessing that said patient suffers from a myeloid malignancy or is prone to suffering from a myeloid malignancy when said one or more mutant alleles of the calreticulin gene is present.

The present invention relates to a method for assessing whether a patient suffers from a myeloid malignancy or is prone to suffering from a myeloid malignancy, said method comprising
- determining the presence of one or more mutant alleles of the calreticulin gene in a sample from said patient;
- determining the presence of a wild type JAK2 protein or a wild type JAK2 nucleic acid in a sample from said patient;
- determining the presence of a wild type MPL protein or a wild type MPL nucleic acid in a sample from said patient; and
- assessing that said patient suffers from a myeloid malignancy or is prone to suffering from a myeloid malignancy when said one or more mutant alleles of the calreticulin gene is present.

Preferably, the method of the invention relates solely to the assessment whether a patient suffers from a myeloid malignancy.

The present invention relates to a method for assessing whether a patient suffers from a myeloid malignancy, said method comprising
- determining the presence of one or more mutant alleles of the calreticulin gene in a sample from said patient; and
- assessing that said patient suffers from a myeloid malignancy when said one or more mutant alleles of the calreticulin gene is present.

The present invention relates to a method for assessing whether a patient suffers from primary myelofibrosis or is prone to suffering from primary myelofibrosis, said method comprising
- determining the presence of one or more mutant alleles of the calreticulin gene in a sample from said patient; and
- assessing that said patient suffers from primary myelofibrosis or is prone to suffering from primary myelofibrosis when said one or more mutant alleles of the calreticulin gene is present.

The present invention relates to a method for assessing whether a patient suffers from essential thrombocythemia or is prone to suffering from essential thrombocythemia, said method comprising
- determining the presence of one or more mutant alleles of the calreticulin gene in a sample from said patient; and
- assessing that said patient suffers from essential thrombocythemia or is prone to suffering from essential thrombocythemia when said one or more mutant alleles of the calreticulin gene is present.

The present invention relates to a method for assessing whether a patient suffers from refractory anemia with ringed sideroblasts and thrombocythemia or is prone to suffering from refractory anemia with ringed sideroblasts and thrombocythemia, said method comprising
- determining the presence of one or more mutant alleles of the calreticulin gene in a sample from said patient; and
- assessing that said patient suffers from refractory anemia with ringed sideroblasts and thrombocythemia or is prone to suffering from refractory anemia with ringed sideroblasts and thrombocythemia when said one or more mutant alleles of the calreticulin gene is present.

The method provided herein comprises determining the presence of preferably solely one mutant allele of the calreticulin gene in a sample from the patient. Preferably, the method is an in vitro method. The herein provided and disclosed mutations of the calreticulin gene are somatic mutations. These mutations can be present in a homozygous state or a heterozyguous state, preferably in a heterozyguous state.

The one or more mutant alleles of the calreticulin gene can comprise a nucleic acid encoding a mutant calreticulin protein. The mutant calreticulin proteins disclosed and provided herein are characterized by a common C-terminal amino acid sequence. As it is evident, for example, from TABLE 6 in the Example, the C-termini of the mutant calreticulin proteins have a common minimum sequence. Said common minimum sequence is shown the amino acid sequence as depicted in SEQ ID NO. 4 and is encoded by nucleic acid molecules having a nucleic acid sequence as depicted in SEQ ID NO: 1, 2 or 3.

Accordingly, the mutant calreticulin protein to be used in accordance with the present invention is selected from the group consisting of
(a) a protein encoded by a nucleic acid molecule having the nucleic acid sequence as depicted in SEQ ID NO: 1, 2 or 3;
(b) a protein comprising the amino acid sequence as shown in SEQ ID NO: 4;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 4;

(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

In one embodiment, the mutant calreticulin protein to be used in accordance with the present invention is
(a) a protein encoded by a nucleic acid molecule having the nucleic acid sequence as depicted in SEQ ID NO: 1, 2 or 3; or
(b) a protein comprising the amino acid sequence as shown in SEQ ID NO: 4.

The present invention relates to a method for assessing whether a patient suffers from primary myelofibrosis or is prone to suffering from primary myelofibrosis, said method comprising
    determining the presence of one or more mutant alleles of the calreticulin gene in a sample from said patient; and
    assessing that said patient suffers from primary myelofibrosis or is prone to suffering from primary myelofibrosis when said one or more mutant alleles of the calreticulin gene is present,
wherein said one or more mutant alleles of the calreticulin gene comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 1, 2 or 3;
(b) a protein comprising the amino acid sequence as shown in SEQ ID NO: 4;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 4;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from primary myelofibrosis or is prone to suffering from primary myelofibrosis, said method comprising
    determining the presence of one or more mutant alleles of the calreticulin gene in a sample from said patient; and
    assessing that said patient suffers from primary myelofibrosis or is prone to suffering from primary myelofibrosis when said one or more mutant alleles of the calreticulin gene is present,
wherein said one or more mutant alleles of the calreticulin gene comprises a nucleic acid encoding a mutant calreticulin protein,
wherein said mutant calreticulin protein is
(a) a protein encoded by a nucleic acid molecule having the nucleic acid sequence as depicted in SEQ ID NO: 1, 2 or 3; or
(b) a protein comprising the amino acid sequence as shown in SEQ ID NO: 4.

The present invention relates to a method for assessing whether a patient suffers from essential thrombocythemia or is prone to suffering from essential thrombocythemia, said method comprising
    determining the presence of one or more mutant alleles of the calreticulin gene in a sample from said patient; and
    assessing that said patient suffers from essential thrombocythemia or is prone to suffering from essential thrombocythemia when said one or more mutant alleles of the calreticulin gene is present,
wherein said one or more mutant alleles of the calreticulin gene comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 1, 2 or 3;
(b) a protein comprising the amino acid sequence as shown in SEQ ID NO: 4;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 4;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from essential thrombocythemia or is prone to suffering from essential thrombocythemia, said method comprising
    determining the presence of one or more mutant alleles of the calreticulin gene in a sample from said patient; and
    assessing that said patient suffers from essential thrombocythemia or is prone to suffering from essential thrombocythemia when said one or more mutant alleles of the calreticulin gene is present,
wherein said one or more mutant alleles of the calreticulin gene comprises a nucleic acid encoding a mutant calreticulin protein,
wherein said mutant calreticulin protein is
(a) a protein encoded by a nucleic acid molecule having the nucleic acid sequence as depicted in SEQ ID NO: 1, 2 or 3; or
(b) a protein comprising the amino acid sequence as shown in SEQ ID NO: 4.

The present invention relates to a method for assessing whether a patient suffers from refractory anemia with ringed sideroblasts and thrombocythemia (RARS-T) or is prone to suffering from refractory anemia with ringed sideroblasts and thrombocythemia (RARS-T), said method comprising
    determining the presence of one or more mutant alleles of the calreticulin gene in a sample from said patient; and
    assessing that said patient suffers from refractory anemia with ringed sideroblasts and thrombocythemia (RARS-T) or is prone to suffering from refractory anemia with ringed sideroblasts and thrombocythemia (RARS-T) when said one or more mutant alleles of the calreticulin gene is present, wherein said one or more mutant alleles of the calreticulin gene comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 1, 2 or 3;
(b) a protein comprising the amino acid sequence as shown in SEQ ID NO: 4;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 4;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from refractory anemia with ringed sideroblasts and thrombocythemia (RARS-T) or is prone to suffering from refractory anemia with ringed sideroblasts and thrombocythemia (RARS-T), said method comprising
determining the presence of one or more mutant alleles of the calreticulin gene in a sample from said patient; and
assessing that said patient suffers from refractory anemia with ringed sideroblasts and thrombocythemia (RARS-T) or is prone to suffering from refractory anemia with ringed sideroblasts and thrombocythemia (RARS-T) when said one or more mutant alleles of the calreticulin gene is present,
wherein said one or more mutant alleles of the calreticulin gene comprises a nucleic acid encoding a mutant calreticulin protein,
wherein said mutant calreticulin protein is
(a) a protein encoded by a nucleic acid molecule having the nucleic acid sequence as depicted in SEQ ID NO: 1, 2 or 3; or
(b) a protein comprising the amino acid sequence as shown in SEQ ID NO: 4.

The mutant calreticulin proteins provided and to be used herein have characteristic C-termini, which are shown in SEQ ID NO:s 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, and 144. These C-termini comprise the amino acid sequence as shown in SEQ ID NO: 4.

The mutant calreticulin protein can, in accordance with the above, be selected from the group consisting of
(a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, or 143;
(b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from a primary myelofibrosis or is prone to suffering from primary myelofibrosis, said method comprising
determining the presence of one or more mutant alleles of the calreticulin gene in a sample from said patient; and
assessing that said patient suffers from primary myelofibrosis or is prone to suffering from primary myelofibrosis when said one or more mutant alleles of the calreticulin gene is present,
wherein said one or more mutant alleles of the calreticulin gene comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, or 143;
(b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from essential thrombocythemia or is prone to suffering from essential thrombocythemia, said method comprising determining the presence of one or more mutant alleles of
the calreticulin gene in a sample from said patient; and
assessing that said patient suffers from essential thrombocythemia or is prone to suffering from essential thrombocythemia when said one or more mutant alleles of the calreticulin gene is present,
wherein said one or more mutant alleles of the calreticulin gene comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, or 143;
(b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from refractory anemia with ringed sideroblasts and thrombocythemia (RARS-T) or is prone to suffering from refractory anemia with ringed sideroblasts and thrombocythemia (RARS-T), said method comprising
determining the presence of one or more mutant alleles of the calreticulin gene in a sample from said patient; and
assessing that said patient suffers from refractory anemia with ringed sideroblasts and thrombocythemia (RARS-T) or is prone to suffering from refractory anemia with ringed sideroblasts and thrombocythemia (RARS-T) when said one or more mutant alleles of the calreticulin gene is present,
wherein said one or more mutant alleles of the calreticulin gene comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, or 143;
(b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

In one embodiment, the mutant calreticulin protein is selected from the group consisting of
(a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, or 143; and
(b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144.

The present invention relates to a method for assessing whether a patient suffers from primary myelofibrosis or is prone to suffering from primary myelofibrosis, said method comprising
determining the presence of one or more mutant alleles of the calreticulin gene in a sample from said patient; and
assessing that said patient suffers from primary myelofibrosis or is prone to suffering from primary myelofibrosis when said one or more mutant alleles of the calreticulin gene is present,
wherein said one or more mutant alleles of the calreticulin gene comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, or 143; and
(b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144.

The present invention relates to a method for assessing whether a patient suffers from essential thrombocythemia or is prone to suffering from essential thrombocythemia, said method comprising determining the presence of one or more mutant alleles of the calreticulin gene in a sample from said patient; and
assessing that said patient suffers from essential thrombocythemia or is prone to suffering from essential thrombocythemia when said one or more mutant alleles of the calreticulin gene is present, wherein said one or more mutant alleles of the calreticulin gene comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, or 143; and
(b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144.

The present invention relates to a method for assessing whether a patient suffers from refractory anemia with ringed sideroblasts and thrombocythemia (RARS-T) or is prone to suffering from refractory anemia with ringed sideroblasts and thrombocythemia (RARS-T), said method comprising determining the presence of one or more mutant alleles of the calreticulin gene in a sample from said patient; and
assessing that said patient suffers from refractory anemia with ringed sideroblasts and thrombocythemia (RARS-T) or is prone to suffering from refractory anemia with ringed sideroblasts and thrombocythemia (RARS-T) when said one or more mutant alleles of the calreticulin gene is present, wherein said one or more mutant alleles of the calreticulin gene comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, or 143; and
(b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144.

Herein, 36 types of mutant calreticulin protein have been identified (see TABLE 6 showing C-termini of the full-length mutant calreticulin proteins). These mutant proteins are unified by their common characteristic C-terminus as shown in SEQ ID NO. 4. The full-length sequences of the mutant calreticulin proteins are shown in SEQ ID NOs: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, and 288.

Accordingly, the mutant calreticulin protein provided and to be used herein can be selected from the group consisting of
(a) a protein encoded by a nucleic acid molecule having the nucleic acid sequence as depicted in SEQ ID NO: 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, or 287;
(b) a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from primary myelofibrosis or is prone to suffering from primary myelofibrosis, said method comprising determining the presence of one or more mutant alleles of the calreticulin gene in a sample from said patient; and
assessing that said patient suffers from primary myelofibrosis or is prone to suffering from primary myelofibrosis when said one or more mutant alleles of the calreticulin gene is present, wherein said one or more mutant alleles of the calreticulin gene comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, or 287;
(b) a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from essential thrombocythemia or is prone to suffering from essential thrombocythemia, said method comprising
  determining the presence of one or more mutant alleles of the calreticulin gene in a sample from said patient; and
  assessing that said patient suffers from essential thrombocythemia or is prone to suffering from essential thrombocythemia when said one or more mutant alleles of the calreticulin gene is present,
wherein said one or more mutant alleles of the calreticulin gene comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, or 287;
(b) a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from refractory anemia with ringed sideroblasts and thrombocythemia (RARS-T) or is prone to suffering from refractory anemia with ringed sideroblasts and thrombocythemia (RARS-T), said method comprising
  determining the presence of one or more mutant alleles of the calreticulin gene in a sample from said patient; and
  assessing that said patient suffers from refractory anemia with ringed sideroblasts and thrombocythemia (RARS-T) or is prone to suffering from refractory anemia with ringed sideroblasts and thrombocythemia (RARS-T) when said one or more mutant alleles of the calreticulin gene is present,
wherein said one or more mutant alleles of the calreticulin gene comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, or 287;
(b) a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

In one embodiment, the mutant calreticulin protein provided and to be used herein can be selected from the group consisting of
(a) a protein encoded by a nucleic acid molecule having the nucleic acid sequence as depicted in SEQ ID NO: 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, or 287; and
(b) a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288.

The present invention relates to a method for assessing whether a patient suffers from primary myelofibrosis or is prone to suffering from primary myelofibrosis, said method comprising
determining the presence of one or more mutant alleles of the calreticulin gene in a sample from said patient; and
assessing that said patient suffers from primary myelofibrosis or is prone to suffering from primary myelofibrosis when said one or more mutant alleles of the calreticulin gene is present,
wherein said one or more mutant alleles of the calreticulin gene comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, or 287; and
(b) a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288.

The present invention relates to a method for assessing whether a patient suffers from essential thrombocythemia or is prone to suffering from essential thrombocythemia, said method comprising
determining the presence of one or more mutant alleles of the calreticulin gene in a sample from said patient; and
assessing that said patient suffers from essential thrombocythemia or is prone to suffering from essential thrombocythemia when said one or more mutant alleles of the calreticulin gene is present,
wherein said one or more mutant alleles of the calreticulin gene comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, or 287; and
(b) a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288.

The present invention relates to a method for assessing whether a patient suffers from refractory anemia with ringed sideroblasts and thrombocythemia (RARS-T) or is prone to suffering from refractory anemia with ringed sideroblasts and thrombocythemia (RARS-T), said method comprising
determining the presence of one or more mutant alleles of the calreticulin gene in a sample from said patient; and
assessing that said patient suffers from refractory anemia with ringed sideroblasts and thrombocythemia (RARS-T) or is prone to suffering from refractory anemia with ringed sideroblasts and thrombocythemia (RARS-T) when said one or more mutant alleles of the calreticulin gene is present,
wherein said one or more mutant alleles of the calreticulin gene comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, or 287; and
(b) a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288.

It has been shown herein that the identified mutations occur in exon 9 of the calreticulin gene. The following relates therefore to the mutations in the wild-type calreticulin gene and in exon 9 thereof.

The wild-type calreticulin gene is well known. Its nucleic acid sequence and amino acid sequence can be obtained from databases like NCBI under accession number NG_029662.1 (gene) and NP_004334.1 (protein).

An exemplary nucleic acid sequence of the wild-type calreticulin gene is shown in SEQ ID NO: 289. The corresponding amino acid sequence is shown in SEQ ID NO: 290.

Accordingly, the wild-type calreticulin gene can comprise a sequence selected from the group consisting of:
a) a nucleic acid encoding a polypeptide comprising an amino acid sequence as depicted in SEQ ID NO: 290;
(b) a nucleic acid comprising a nucleotide sequence as depicted in SEQ ID NO: 289;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The one or more mutant allele of the calreticulin gene can be in a region encompassing exon 9 of the above described calreticulin gene. The wild-type nucleic acid sequence of exon 9 of the calreticulin gene is shown in SEQ ID NO:435. The corresponding wild-type amino acid sequence is shown SEQ ID NO:436.

In accordance with the above, exon 9 of the wild-type calreticulin gene can comprise a sequence selected from the group consisting of:
a) a nucleic acid encoding a polypeptide comprising an amino acid sequence as depicted in SEQ ID NO:436;
(b) a nucleic acid comprising a nucleotide sequence as depicted in SEQ ID NO:435;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

As shown herein (see, for example, TABLE 6), the herein provided mutant alleles of the calreticulin genes have a frameshift mutation compared to the wild-type calreticulin gene. The frameshift mutation can be in exon 9 of the wild-type calreticulin gene. Due to the frameshift mutation, the open reading frame of the wild-type calreticulin gene is no longer used, but an alternative frame 1, which leads to the generation of the characteristic C-terminus of the mutant calreticulin proteins (the common minimum amino acid sequence of the mutant proteins is shown in SEQ ID NO. 4).

The frameshift mutation can be caused by the deletion of one or more nucleotides, by the insertion of two or more nucleotides or a combination of insertion and deletion of one or more nucleotides, provided that the mutant protein comprises the characteristic C-terminus (as shown in SEQ ID NO: 4) or a fragment thereof.

For example, the frameshift mutation is (or is caused by) the deletion of one nucleotide from the coding sequence of the wild-type calreticulin gene, particularly from exon 9 thereof, or the insertion of two nucleotides into the coding sequence of the wild-type calreticulin gene, particularly into exon 9 thereof.

For example, $(1+(3 \times n_0))$ nucleotides can be deleted from the calreticulin gene (or from exon 9 thereof), whereby $n_0$ can be any natural number including zero. Non-limiting examples of the number of nucleotides that can be deleted from the calreticulin gene (or from exon 9 thereof) to generate a nucleic acid encoding the herein provided mutant calreticulin proteins are 1, 4, 19, 22, 31, 34, 46, 52 nucleotides.

Likewise, the frameshift mutation can be (or can be caused by) the insertion of two nucleotides into the coding sequence of the wild-type calreticulin gene, particularly in exon 9 thereof. Accordingly, $(2+(3 \times n_0))$ nucleotides can be inserted into the calreticulin gene (or into exon 9 thereof), whereby $n_0$ can be any natural number including zero. For example, 5 nucleotides can be inserted into the calreticulin gene (or into exon 9 thereof) to generate a nucleic acid encoding the herein provided mutant calreticulin proteins.

The frameshift mutation can also be caused by a combination of insertion and deletion of one or more nucleotides into/from the wild-type calreticulin gene (or into/from exon 9 thereof), provided that the resulting mutant protein comprises the characteristic C-terminus (as shown in SEQ ID NO: 4) or a fragment thereof.

For example, the frameshift mutation can be (or can be caused by) the deletion of one nucleotide from the coding sequence of the wild-type calreticulin gene, particularly from exon 9 thereof, and by the insertion of six nucleotides into the coding sequence of the wild-type calreticulin gene, particularly into exon 9 thereof.

For example, the frameshift mutation can be (or can be caused by) the deletion of two nucleotides from the coding sequence of the wild-type calreticulin gene, particularly from exon 9 thereof, and by the insertion of four nucleotides into the coding sequence of the wild-type calreticulin gene, particularly into exon 9 thereof.

For example, the frameshift mutation can be (or can be caused by) the deletion of three nucleotides from the coding sequence of the wild-type calreticulin gene, particularly from exon 9 thereof, and by the insertion of five nucleotides into the coding sequence of the wild-type calreticulin gene, particularly into exon 9 thereof.

For example, the frameshift mutation can be (or can be caused by) the deletion of 12 nucleotides from the coding sequence of the wild-type calreticulin gene, particularly from exon 9 thereof, and by the insertion of 5 nucleotides into the coding sequence of the wild-type calreticulin gene, particularly into exon 9 thereof.

For example, the frameshift mutation can be (or can be caused by) the deletion of 18 nucleotides from the coding sequence of the wild-type calreticulin gene, particularly from exon 9 thereof, and by the insertion of 11 nucleotides into the coding sequence of the wild-type calreticulin gene, particularly into exon 9 thereof.

For example, the frameshift mutation can be (or can be caused by) the deletion of 18 nucleotides from the coding sequence of the wild-type calreticulin gene, particularly from exon 9 thereof, and by the insertion of 14 nucleotides into the coding sequence of the wild-type calreticulin gene, particularly into exon 9 thereof.

For example, the frameshift mutation can be (or can be caused by) the deletion of 20 nucleotides from the coding sequence of the wild-type calreticulin gene, particularly from exon 9 thereof, and by the insertion of 1 nucleotide into the coding sequence of the wild-type calreticulin gene, particularly into exon 9 thereof.

For example, the frameshift mutation can be (or can be caused by) the deletion of 28 nucleotides from the coding sequence of the wild-type calreticulin gene, particularly from exon 9 thereof, and by the insertion of 6 nucleotides into the coding sequence of the wild-type calreticulin gene, particularly into exon 9 thereof.

For example, the frameshift mutation can be (or can be caused by) the deletion of 35 nucleotides from the coding sequence of the wild-type calreticulin gene, particularly from exon 9 thereof, and by the insertion of 1 nucleotide into the coding sequence of the wild-type calreticulin gene, particularly into exon 9 thereof.

For example, the frameshift mutation can be (or can be caused by) the deletion of 36 nucleotides from the coding sequence of the wild-type calreticulin gene, particularly from exon 9 thereof, and by the insertion of 2 nucleotide into the coding sequence of the wild-type calreticulin gene, particularly into exon 9 thereof.

Further combinations of insertion/deletion inventions that result in the generation of the characteristic C-terminus of the mutant calreticulin proteins (the common minimum amino acid sequence of the mutant proteins is shown in SEQ ID NO. 4) or of a fragment thereof are readily conceivable.

Due to the above described insertions, deletions and combinations of insertions/deletions, a frameshift is introduced into the (coding sequence of the) wild-type calreticulin gene and particularly in exon 9 thereof. Accordingly, the mutant calreticulin protein disclosed herein and to be used in accordance with the present invention comprises a mutant amino acid stretch encoded by these mutant exon 9 sequences.

Accordingly, the mutant calreticulin protein can be selected from the group consisting of
(a) a protein encoded by a nucleic acid molecule having the nucleic acid sequence as depicted in SEQ ID NO: 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433;
(b) a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from primary myelofibrosis or is prone to suffering from primary myelofibrosis, said method comprising
  determining the presence of one or more mutant alleles of the calreticulin gene in a sample from said patient; and
  assessing that said patient suffers from primary myelofibrosis or is prone to suffering from primary myelofibrosis when said one or more mutant alleles of the calreticulin gene is present,
wherein said one or more mutant alleles of the calreticulin gene comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433;
(b) a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from essential thrombocythemia or is prone to suffering from essential thrombocythemia, said method comprising
  determining the presence of one or more mutant alleles of the calreticulin gene in a sample from said patient; and
  assessing that said patient suffers from essential thrombocythemia or is prone to suffering from essential thrombocythemia when said one or more mutant alleles of the calreticulin gene is present,
wherein said one or more mutant alleles of the calreticulin gene comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433;
(b) a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and (g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from refractory anemia with ringed sideroblasts and thrombocythemia (RARS-T) or is prone to suffering from refractory anemia with ringed sideroblasts and thrombocythemia (RARS-T), said method comprising
  determining the presence of one or more mutant alleles of the calreticulin gene in a sample from said patient; and
  assessing that said patient suffers from refractory anemia with ringed sideroblasts and thrombocythemia (RARS-T) or is prone to suffering from refractory anemia with ringed sideroblasts and thrombocythemia (RARS-T) when said one or more mutant alleles of the calreticulin gene is present,
wherein said one or more mutant alleles of the calreticulin gene comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433;
(b) a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

In one embodiment, the mutant calreticulin protein is selected from the group consisting of
(a) a protein encoded by a nucleic acid molecule having the nucleic acid sequence as depicted in SEQ ID NO: 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433; and
(b) a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434.

The present invention relates to a method for assessing whether a patient suffers from primary myelofibrosis or is prone to suffering from primary myelofibrosis, said method comprising
  determining the presence of one or more mutant alleles of the calreticulin gene in a sample from said patient; and
  assessing that said patient suffers from primary myelofibrosis or is prone to suffering from primary myelofibrosis when said one or more mutant alleles of the calreticulin gene is present,
wherein said one or more mutant alleles of the calreticulin gene comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433; and
(b) a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434.

The present invention relates to a method for assessing whether a patient suffers from essential thrombocythemia or is prone to suffering from essential thrombocythemia, said method comprising
  determining the presence of one or more mutant alleles of the calreticulin gene in a sample from said patient; and
  assessing that said patient suffers from essential thrombocythemia or is prone to suffering from essential thrombocythemia when said one or more mutant alleles of the calreticulin gene is present,
wherein said one or more mutant alleles of the calreticulin gene comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433; and
(b) a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434.

The present invention relates to a method for assessing whether a patient suffers from refractory anemia with ringed sideroblasts and thrombocythemia (RARS-T) or is prone to suffering from refractory anemia with ringed sideroblasts and thrombocythemia (RARS-T), said method comprising
 determining the presence of one or more mutant alleles of the calreticulin gene in a sample from said patient; and
 assessing that said patient suffers from refractory anemia with ringed sideroblasts and thrombocythemia (RARS-T) or is prone to suffering from refractory anemia with ringed sideroblasts and thrombocythemia (RARS-T) when said one or more mutant alleles of the calreticulin gene is present,
wherein said one or more mutant alleles of the calreticulin gene comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433; and
(b) a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434.

The presence of the one or more mutant alleles of the calreticulin gene can be assessed on the genomic level, the mRNA level or the protein level.

If the presence of the one or more mutant alleles of the calreticulin gene is to be assessed on the genomic level, the mutant allele can comprise or consist of DNA, preferably genomic DNA.

For example, the mutant allele can comprise a nucleic acid selected from the group consisting of
(a) a nucleic acid encoding a polypeptide comprising an amino acid sequence as depicted in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288; 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
(b) a nucleic acid comprising a nucleotide sequence as depicted in SEQ ID NO: 1, 5, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 291, 295, 299, 303, 307, 311, 315, 319, 323, 327, 331, 335, 339, 343, 347, 351, 355, 359, 363, 367, 371, 375, 379, 383, 387, 391, 395, 399, 403, 407, 411, 415, 419, 423, 427, or 431;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a method for assessing whether a patient suffers from a primary myelofibrosis or is prone to suffering from primary myelofibrosis, said method comprising
 determining the presence of one or more mutant alleles of the calreticulin gene in a sample from said patient; and
 assessing that said patient suffers from primary myelofibrosis or is prone to suffering from primary myelofibrosis when said one or more mutant alleles of the calreticulin gene is present,
wherein said one or more mutant alleles of the calreticulin gene comprises a nucleic acid encoding a mutant calreticulin protein as defined herein above,
wherein said mutant allele comprises a nucleic acid selected from the group consisting of
(a) a nucleic acid encoding a polypeptide comprising an amino acid sequence as depicted in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288; 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
(b) a nucleic acid comprising a nucleotide sequence as depicted in SEQ ID NO: 1, 5, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 291, 295, 299, 303, 307, 311, 315, 319, 323, 327, 331, 335, 339, 343, 347, 351, 355, 359, 363, 367, 371, 375, 379, 383, 387, 391, 395, 399, 403, 407, 411, 415, 419, 423, 427, or 431;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a method for assessing whether a patient suffers from essential thrombocythemia or is prone to suffering from essential thrombocythemia, said method comprising
 determining the presence of one or more mutant alleles of the calreticulin gene in a sample from said patient; and
 assessing that said patient suffers from essential thrombocythemia or is prone to suffering from essential thrombocythemia when said one or more mutant alleles of the calreticulin gene is present,
wherein said one or more mutant alleles of the calreticulin gene comprises a nucleic acid encoding a mutant calreticulin protein as defined herein above, wherein said mutant allele comprises a nucleic acid selected from the group consisting of
(a) a nucleic acid encoding a polypeptide comprising an amino acid sequence as depicted in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288; 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
(b) a nucleic acid comprising a nucleotide sequence as depicted in SEQ ID NO: 1, 5, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 291, 295, 299, 303, 307, 311, 315, 319, 323, 327, 331, 335, 339, 343, 347, 351, 355, 359, 363, 367, 371, 375, 379, 383, 387, 391, 395, 399, 403, 407, 411, 415, 419, 423, 427, or 431;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a method for assessing whether a patient suffers from refractory anemia with ringed sideroblasts and thrombocythemia (RARS-T) or is prone to suffering from refractory anemia with ringed sideroblasts and thrombocythemia (RARS-T), said method comprising
determining the presence of one or more mutant alleles of the calreticulin gene in a sample from said patient; and
assessing that said patient suffers from refractory anemia with ringed sideroblasts and thrombocythemia (RARS-T) or is prone to suffering from refractory anemia with ringed sideroblasts and thrombocythemia (RARS-T) when said one or more mutant alleles of the calreticulin gene is present,
wherein said one or more mutant alleles of the calreticulin gene comprises a nucleic acid encoding a mutant calreticulin protein as defined herein above,
wherein said mutant allele comprises a nucleic acid selected from the group consisting of
(a) a nucleic acid encoding a polypeptide comprising an amino acid sequence as depicted in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288; 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
(b) a nucleic acid comprising a nucleotide sequence as depicted in SEQ ID NO: 1, 5, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 291, 295, 299, 303, 307, 311, 315, 319, 323, 327, 331, 335, 339, 343, 347, 351, 355, 359, 363, 367, 371, 375, 379, 383, 387, 391, 395, 399, 403, 407, 411, 415, 419, 423, 427, or 431;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

In one embodiment, said mutant allele comprises a nucleic acid selected from the group consisting of
(a) a nucleic acid encoding a polypeptide comprising an amino acid sequence as depicted in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288; 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434; and
(b) a nucleic acid comprising a nucleotide sequence as depicted in SEQ ID NO: 1, 5, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 291, 295, 299, 303, 307, 311, 315, 319, 323, 327, 331, 335, 339, 343, 347, 351, 355, 359, 363, 367, 371, 375, 379, 383, 387, 391, 395, 399, 403, 407, 411, 415, 419, 423, 427, or 431.

The present invention relates to a method for assessing whether a patient suffers from primary myelofibrosis or is prone to suffering from primary myelofibrosis, said method comprising
determining the presence of one or more mutant alleles of the calreticulin gene in a sample from said patient; and
assessing that said patient suffers from primary myelofibrosis or is prone to suffering from primary myelofibrosis when said one or more mutant alleles of the calreticulin gene is present,
wherein said one or more mutant alleles of the calreticulin gene comprises a nucleic acid encoding a mutant calreticulin protein as defined herein above,
wherein said mutant allele comprises a nucleic acid selected from the group consisting of
(a) a nucleic acid encoding a polypeptide comprising an amino acid sequence as depicted in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288; 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434; and
(b) a nucleic acid comprising a nucleotide sequence as depicted in SEQ ID NO: 1, 5, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 291, 295, 299, 303, 307, 311, 315, 319, 323, 327, 331, 335, 339, 343, 347, 351, 355, 359, 363, 367, 371, 375, 379, 383, 387, 391, 395, 399, 403, 407, 411, 415, 419, 423, 427, or 431.

The present invention relates to a method for assessing whether a patient suffers from essential thrombocythemia or is prone to suffering from essential thrombocythemia, said method comprising
determining the presence of one or more mutant alleles of the calreticulin gene in a sample from said patient; and
assessing that said patient suffers from essential thrombocythemia or is prone to suffering from essential thrombocythemia when said one or more mutant alleles of the calreticulin gene is present,
wherein said one or more mutant alleles of the calreticulin gene comprises a nucleic acid encoding a mutant calreticulin protein as defined above,
wherein said mutant calreticulin allele comprises a nucleic acid selected from the group consisting of
(a) a nucleic acid encoding a polypeptide comprising an amino acid sequence as depicted in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288; 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434; and
(b) a nucleic acid comprising a nucleotide sequence as depicted in SEQ ID NO: 1, 5, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 291, 295, 299, 303, 307, 311, 315, 319, 323, 327, 331, 335, 339, 343, 347, 351, 355, 359, 363, 367, 371, 375, 379, 383, 387, 391, 395, 399, 403, 407, 411, 415, 419, 423, 427, or 431.

The present invention relates to a method for assessing whether a patient suffers from refractory anemia with ringed sideroblasts and thrombocythemia (RARS-T) or is prone to suffering from refractory anemia with ringed sideroblasts and thrombocythemia (RARS-T), said method comprising
determining the presence of one or more mutant alleles of the calreticulin gene in a sample from said patient; and
assessing that said patient suffers from refractory anemia with ringed sideroblasts and thrombocythemia (RARS-T) or is prone to suffering from refractory anemia with ringed sideroblasts and thrombocythemia (RARS-T) when said one or more mutant alleles of the calreticulin gene is present,
wherein said one or more mutant alleles of the calreticulin gene comprises a nucleic acid encoding a mutant calreticulin protein as defined herein above,
wherein said mutant allele comprises a nucleic acid selected from the group consisting of
(a) a nucleic acid encoding a polypeptide comprising an amino acid sequence as depicted in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288; 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434; and
(b) a nucleic acid comprising a nucleotide sequence as depicted in SEQ ID NO: 1, 5, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 291, 295, 299, 303, 307, 311, 315, 319, 323, 327, 331, 335, 339, 343, 347, 351, 355, 359, 363, 367, 371, 375, 379, 383, 387, 391, 395, 399, 403, 407, 411, 415, 419, 423, 427, or 431.

Any methods routinely employed for mutational analyses can be used in accordance with the present invention. The presence of the mutant allele on genomic level, can, for example, be determined by sequencing (such as Sanger sequencing e.g. bidirectional Sanger sequencing) and/or PCR-based detection strategies, such as PCR sizing assays (i.e. PCR followed by fragment analysis e.g. via agarose gel electrophoresis (like high-density agarose gel electrophoresis)).

Detection of a mutation in a nucleic acid can be performed by methods known in the art, including direct sequencing, restriction fragment length polymorphism identification (RFLPI) of genomic DNA, random amplified polymorphic detection (RAPD), amplified fragment length polymorphism detection (AFLPD), polymerase chain reaction (PCR), DNA sequencing, allele specific oligonucleotide (ASO) probes, hybridization to DNA microarrays or beads, high resolution melting (HRM), and TaqMan probe principle. The nucleic acid can be genomic DNA, amplified genomic DNA, mRNA, cDNA, or amplified cDNA.

Sequencing is typically performed on specifically amplified nucleic acids.

Fragment size analysis typically uses differences in sizes of amplicons following PCR.

High resolution melting (HRM) detects mutations in DNA by precisely measuring the melting point of double stranded DNA. Gundry et al., "Amplicon Melting Analysis with Labeled Primers: A Closed-Tube Method for Differentiating Homozygotes and Heterozygotes" *Clinical Chemistry* 49: 396-406 (2003). Typically the user will use PCR to amplify the DNA region in which their mutation of interest lies. The amplified DNA is then precisely heated from around 50° C. up to around 95° C. until the strands separate. This process is typically monitored with fluorescent dyes.

One approach that can be employed herein uses fragment size analysis, followed or not by sequencing. As mentioned above, PCR assays using e.g. genomic DNA of mutant calreticulin as template can be used for amplification of the DNA. Subsequently the amplified DNA can be subject to fragment analysis e.g. via agarose gel electrophoresis.

Methods for determining the presence of the mutant allele on mRNA level or protein level are described further below.

For mRNA, many of the same methods as used for DNA can be performed after reverse transcription to generate cDNA. Other methods include RealTime PCR, ReverseTranscriptase PCR, Whole Transcriptome Shotgun Sequencing (RNAseq), in situ hybridization or micro-arrays. Real Time PCR simultaneously amplifies and detects a sequence of interest. The use of specific primers and fluorescent labels can distinguish between wild type and mutations.

Proteins can be analyzed by methods that include immunohistochemistry (IHC), immunoassay, gel- or blot-based methods, mass spectrometry, flow cytometry, or fluorescent activated cell sorting (FACS). Many methods monitor the binding of an antibody or set of antibodies to a protein of interest that detect differences between a wild type and mutant forms. Mass spectrometry detects differences in the size of a protein and its fragments that reveal information about the underlying sequence.

The present invention also takes advantage of the determination of the presence of a gene product of one or more mutant alleles of the calreticulin gene in order to diagnose myeloid malignancy.

The present invention relates to a method for assessing whether a patient suffers from a myeloid malignancy or is prone to suffering from a myeloid malignancy, said method comprising
   determining the presence of a gene product of one or more mutant alleles of the calreticulin gene in a sample from said patient; and
   assessing that said patient suffers from a myeloid malignancy or is prone to suffering from a myeloid malignancy when said gene product is present.

The methods provided herein can comprise a step of obtaining a sample from the patient.

The present invention relates to a method for assessing whether a patient suffers from a myeloid malignancy or is prone to suffering from a myeloid malignancy, said method comprising
   obtaining a sample from said patient;
   determining the presence of a gene product of one or more mutant alleles of the calreticulin gene in a sample from said patient; and
   assessing that said patient suffers from a myeloid malignancy or is prone to suffering from a myeloid malignancy when said gene product is present.

The method provided herein comprises determining the presence of a gene product of preferably solely one mutant allele of the calreticulin gene in a sample from the patient. Preferably, the method is an in vitro method.

Preferably, the method of the invention relates solely to the assessment whether a patient suffers from a myeloid malignancy.

The present invention relates to a method for assessing whether a patient suffers from a myeloid malignancy, said method comprising
   determining the presence of a gene product of one or more mutant alleles of the calreticulin gene in a sample from said patient; and
   assessing that said patient suffers from a myeloid when said gene product is present.

Myeloid malignancies include myeloproliferative neoplasms and myelodysplastic syndromes. It is preferred herein that the myeloid malignancy is a myeloproliferative neoplasm, particularly primary myelofibrosis (PMF) or essential thrombocythemia (ET), or a myelodysplastic syndrome, particularly refractory anemia with ringed sideroblasts and thrombocythemia (RARS-T).

The present invention relates to a method for assessing whether a patient suffers from primary myelofibrosis or is prone to suffering from primary myelofibrosis, said method comprising
   determining the presence of a gene product of one or more mutant alleles of the calreticulin gene in a sample from said patient; and
   assessing that said patient suffers from primary myelofibrosis or is prone to suffering from primary myelofibrosis when said gene product is present.

The present invention relates to a method for assessing whether a patient suffers from essential thrombocythemia or is prone to suffering from essential thrombocythemia, said method comprising
   determining the presence of a gene product of one or more mutant alleles of the calreticulin gene in a sample from said patient; and
   assessing that said patient suffers from essential thrombocythemia or is prone to suffering from essential thrombocythemia when said gene product is present.

The present invention relates to a method for assessing whether a patient suffers from refractory anemia with ringed sideroblasts and thrombocythemia (RARS-T) or is prone to suffering from refractory anemia with ringed sideroblasts and thrombocythemia (RARS-T), said method comprising
   determining the presence of a gene product of one or more mutant alleles of the calreticulin gene in a sample from said patient; and
   assessing that said patient suffers from refractory anemia with ringed sideroblasts and thrombocythemia (RARS-T) or is prone to suffering from refractory anemia with ringed sideroblasts and thrombocythemia (RARS-T) when said gene product is present.

The one or more mutant alleles can comprise a nucleic acid encoding a mutant calreticulin protein.

The mutant calreticulin protein can be selected from the group consisting of
(a) a protein encoded by a nucleic acid molecule having the nucleic acid sequence as depicted in SEQ ID NO: 1, 2 or 3;
(b) a protein comprising the amino acid sequence as shown in SEQ ID NO: 4;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 4;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from a primary myelofibrosis or is prone to suffering from primary myelofibrosis, said method comprising
   determining the presence of a gene product of one or more mutant alleles of the calreticulin gene in a sample from said patient; and
   assessing that said patient suffers from primary myelofibrosis or is prone to suffering from primary myelofibrosis when said gene product is present,
wherein said one or more mutant alleles comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 1, 2 or 3;
(b) a protein comprising the amino acid sequence as shown in SEQ ID NO: 4;
(c) a protein as defined in (a) or (b) wherein one or more amino acids are deleted, inserted, added or substituted;

(d) a protein encoded by a nucleic acid molecule encoding a protein comprising the amino acid sequence as shown in SEQ ID NO: 4;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from a primary myelofibrosis or is prone to suffering from primary myelofibrosis, said method comprising
determining the presence of a gene product of one or more mutant alleles of the calreticulin gene in a sample from said patient; and
assessing that said patient suffers from primary myelofibrosis or is prone to suffering from primary myelofibrosis when said gene product is present,
wherein said one or more mutant alleles comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 1, 2 or 3; and
(b) a protein comprising the amino acid sequence as shown in SEQ ID NO: 4.

The present invention relates to a method for assessing whether a patient suffers from essential thrombocythemia or is prone to suffering from essential thrombocythemia, said method comprising
determining the presence of a gene product of one or more mutant alleles of the calreticulin gene in a sample from said patient; and
assessing that said patient suffers from essential thrombocythemia or is prone to suffering from essential thrombocythemia when said gene product is present,
wherein said one or more mutant alleles comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 1, 2 or 3;
(b) a protein comprising the amino acid sequence as shown in SEQ ID NO: 4;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 4;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from essential thrombocythemia or is prone to suffering from essential thrombocythemia, said method comprising
determining the presence of a gene product of one or more mutant alleles of the calreticulin gene in a sample from said patient; and
assessing that said patient suffers from essential thrombocythemia or is prone to suffering from essential thrombocythemia when said gene product is present,
wherein said one or more mutant alleles comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 1, 2 or 3; and
(b) a protein comprising the amino acid sequence as shown in SEQ ID NO: 4.

The present invention relates to a method for assessing whether a patient suffers from a refractory anemia with ringed sideroblasts and thrombocythemia (RARS-T) or is prone to suffering from refractory anemia with ringed sideroblasts and thrombocythemia (RARS-T), said method comprising
determining the presence of a gene product of one or more mutant alleles of the calreticulin gene in a sample from said patient; and
assessing that said patient suffers from refractory anemia with ringed sideroblasts and thrombocythemia (RARS-T) or is prone to suffering from refractory anemia with ringed sideroblasts and thrombocythemia (RARS-T) when said gene product is present,
wherein said one or more mutant alleles comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 1, 2 or 3;
(b) a protein comprising the amino acid sequence as shown in SEQ ID NO: 4;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 4;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from a refractory anemia with ringed sideroblasts and thrombocythemia (RARS-T) or is prone to suffering from refractory anemia with ringed sideroblasts and thrombocythemia (RARS-T), said method comprising
determining the presence of a gene product of one or more mutant alleles of the calreticulin gene in a sample from said patient; and
assessing that said patient suffers from refractory anemia with ringed sideroblasts and thrombocythemia (RARS-T) or is prone to suffering from refractory anemia with ringed sideroblasts and thrombocythemia (RARS-T) when said gene product is present,
wherein said one or more mutant alleles comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 1, 2 or 3; and
(b) a protein comprising the amino acid sequence as shown in SEQ ID NO: 4.

The mutant calreticulin protein can be selected from the group consisting of
(a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, or 143;
(b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from a primary myelofibrosis or is prone to suffering from primary myelofibrosis, said method comprising
determining the presence of a gene product of one or more mutant alleles of the calreticulin gene in a sample from said patient; and
assessing that said patient suffers from primary myelofibrosis or is prone to suffering from primary myelofibrosis when said gene product is present,
wherein said one or more mutant alleles comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, or 143;

(b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from a primary myelofibrosis or is prone to suffering from primary myelofibrosis, said method comprising
determining the presence of a gene product of one or more mutant alleles of the calreticulin gene in a sample from said patient; and
assessing that said patient suffers from primary myelofibrosis or is prone to suffering from primary myelofibrosis when said gene product is present,
wherein said one or more mutant alleles comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, or 143; and
(b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;

The present invention relates to a method for assessing whether a patient suffers from essential thrombocythemia or is prone to suffering from essential thrombocythemia, said method comprising
determining the presence of a gene product of one or more mutant alleles of the calreticulin gene in a sample from said patient; and
assessing that said patient suffers from essential thrombocythemia or is prone to suffering from essential thrombocythemia when said gene product is present,
wherein said one or more mutant alleles comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, or 143;
(b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from essential thrombocythemia or is prone to suffering from essential thrombocythemia, said method comprising
  determining the presence of a gene product of one or more mutant alleles of the calreticulin gene in a sample from said patient; and
  assessing that said patient suffers from essential thrombocythemia or is prone to suffering from essential thrombocythemia when said gene product is present,
wherein said one or more mutant alleles comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, or 143; and
(b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144.

The present invention relates to a method for assessing whether a patient suffers from a refractory anemia with ringed sideroblasts and thrombocythemia (RARS-T) or is prone to suffering from refractory anemia with ringed sideroblasts and thrombocythemia (RARS-T), said method comprising
  determining the presence of a gene product of one or more mutant alleles of the calreticulin gene in a sample from said patient; and
  assessing that said patient suffers from refractory anemia with ringed sideroblasts and thrombocythemia (RARS-T) or is prone to suffering from refractory anemia with ringed sideroblasts and thrombocythemia (RARS-T) when said gene product is present,
wherein said one or more mutant alleles comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, or 143;
(b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from a refractory anemia with ringed sideroblasts and thrombocythemia (RARS-T) or is prone to suffering from refractory anemia with ringed sideroblasts and thrombocythemia (RARS-T), said method comprising
  determining the presence of a gene product of one or more mutant alleles of the calreticulin gene in a sample from said patient; and
  assessing that said patient suffers from refractory anemia with ringed sideroblasts and thrombocythemia (RARS-T) or is prone to suffering from refractory anemia with ringed sideroblasts and thrombocythemia (RARS-T) when said gene product is present,
wherein said one or more mutant alleles comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, or 143; and
(b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144.

The mutant calreticulin protein can be selected from the group consisting of
(a) a protein encoded by a nucleic acid molecule having the nucleic acid sequence as depicted in SEQ ID NO: 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433;

(b) a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;

(c) a protein as defined in (a) or (b) wherein one or more amino acids are deleted, inserted, added or substituted;

(d) a protein encoded by a nucleic acid molecule encoding a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;

(e) a protein comprising an amino acid sequence encoded by a nucleic acid hybridizing under stringent conditions to the complementary strand of nucleic acid molecules as defined in (a) or (c);

(f) a protein having at least 70% identity to the protein of any one of (a) to (e); and (g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from a primary myelofibrosis or is prone to suffering from primary myelofibrosis, said method comprising determining the presence of a gene product of one or more mutant alleles of the calreticulin gene in a sample from said patient; and assessing that said patient suffers from primary myelofibrosis or is prone to suffering from primary myelofibrosis when said gene product is present, wherein said one or more mutant alleles comprises a nucleic acid encoding a mutant calreticulin protein, wherein said mutant calreticulin protein is selected from the group consisting of (a) a protein encoded by a nucleic acid molecule having the nucleic acid sequence as depicted in SEQ ID NO: 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433; and (b) a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434.

The present invention relates to a method for assessing whether a patient suffers from essential thrombocythemia or is prone to suffering from essential thrombocythemia, said method comprising determining the presence of a gene product of one or more mutant alleles of the calreticulin gene in a sample from said patient; and assessing that said patient suffers from essential thrombocythemia or is prone to suffering from essential thrombocythemia when said gene product is present, wherein said one or more mutant alleles comprises a nucleic acid encoding a mutant calreticulin protein, wherein said mutant calreticulin protein is selected from the group consisting of (a) a protein encoded by a nucleic acid molecule having the nucleic acid sequence as depicted in SEQ ID NO: 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433;
(b) a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from essential thrombocythemia or is prone to suffering from essential thrombocythemia, said method comprising
  determining the presence of a gene product of one or more mutant alleles of the calreticulin gene in a sample from said patient; and
  assessing that said patient suffers from essential thrombocythemia or is prone to suffering from essential thrombocythemia when said gene product is present,
wherein said one or more mutant alleles comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433; and
(b) a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;

The present invention relates to a method for assessing whether a patient suffers from a refractory anemia with ringed sideroblasts and thrombocythemia (RARS-T) or is prone to suffering from refractory anemia with ringed sideroblasts and thrombocythemia (RARS-T), said method comprising
  determining the presence of a gene product of one or more mutant alleles of the calreticulin gene in a sample from said patient; and
  assessing that said patient suffers from refractory anemia with ringed sideroblasts and thrombocythemia (RARS-T) or is prone to suffering from refractory anemia with ringed sideroblasts and thrombocythemia (RARS-T) when said gene product is present,
wherein said one or more mutant alleles comprises a nucleic acid encoding a mutant calreticulin protein,
wherein said mutant calreticulin protein is selected from the group consisting of
(a) a protein encoded by a nucleic acid molecule having the nucleic acid sequence as depicted in SEQ ID NO: 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433;
(b) a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from a refractory anemia with ringed sideroblasts and thrombocythemia (RARS-T) or is prone to suffering from refractory anemia with ringed sideroblasts and thrombocythemia (RARS-T), said method comprising
  determining the presence of a gene product of one or more mutant alleles of the calreticulin gene in a sample from said patient; and
  assessing that said patient suffers from refractory anemia with ringed sideroblasts and thrombocythemia (RARS-T) or is prone to suffering from refractory anemia with ringed sideroblasts and thrombocythemia (RARS-T) when said gene product is present,
wherein said one or more mutant alleles comprises a nucleic acid encoding a mutant calreticulin protein,
wherein said mutant calreticulin protein is selected from the group consisting of wherein said mutant calreticulin protein is selected from the group consisting of
(a) a protein encoded by a nucleic acid molecule having the nucleic acid sequence as depicted in SEQ ID NO: 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433; and
(b) a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434.

The mutant allele can comprise a nucleic acid selected from the group consisting of
(a) a nucleic acid encoding a polypeptide comprising an amino acid sequence as depicted in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288; 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
(b) a nucleic acid comprising a nucleotide sequence as depicted in SEQ ID NO: 1, 5, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 291, 295, 299, 303, 307, 311, 315, 319, 323, 327, 331, 335, 339, 343, 347, 351, 355, 359, 363, 367, 371, 375, 379, 383, 387, 391, 395, 399, 403, 407, 411, 415, 419, 423, 427, or 431;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The gene product can be an mRNA. For example, the gene product can be an mRNA encoding the C-terminal amino acid sequence of the herein provided mutant calreticulin proteins.

Accordingly, the gene product can comprise a nucleic acid selected from the group consisting of
(a) a nucleic acid encoding a polypeptide comprising an amino acid sequence as depicted in SEQ ID NO:4;
(b) a nucleic acid comprising a nucleotide sequence as depicted in SEQ ID NO: 3;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a method for assessing whether a patient suffers from a primary myelofibrosis or is prone to suffering from primary myelofibrosis, said method comprising
determining the presence of a gene product of one or more mutant alleles of the calreticulin gene in a sample from said patient; and
assessing that said patient suffers from primary myelofibrosis or is prone to suffering from primary myelofibrosis when said gene product is present,
wherein said one or more mutant alleles comprises a nucleic acid encoding a mutant calreticulin protein as defined herein above,
wherein said gene product is selected from the group consisting of
(a) a nucleic acid encoding a polypeptide comprising an amino acid sequence as depicted in SEQ ID NO:4;
(b) a nucleic acid comprising a nucleotide sequence as depicted in SEQ ID NO: 3;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a method for assessing whether a patient suffers from a primary myelofibrosis or is prone to suffering from primary myelofibrosis, said method comprising
determining the presence of a gene product of one or more mutant alleles of the calreticulin gene in a sample from said patient; and
assessing that said patient suffers from primary myelofibrosis or is prone to suffering from primary myelofibrosis when said gene product is present,
wherein said one or more mutant alleles comprises a nucleic acid encoding a mutant calreticulin protein as defined herein above,
wherein said gene product is selected from the group consisting of
(a) a nucleic acid encoding a polypeptide comprising an amino acid sequence as depicted in SEQ ID NO:4; and
(b) a nucleic acid comprising a nucleotide sequence as depicted in SEQ ID NO: 3.

The present invention relates to a method for assessing whether a patient suffers from essential thrombocythemia or is prone to suffering from essential thrombocythemia, said method comprising
determining the presence of a gene product of one or more mutant alleles of the calreticulin gene in a sample from said patient; and
assessing that said patient suffers from essential thrombocythemia or is prone to suffering from essential thrombocythemia when said gene product is present,
wherein said one or more mutant alleles comprises a nucleic acid encoding a mutant calreticulin protein as defined herein above,
wherein said gene product is selected from the group consisting of
(a) a nucleic acid encoding a polypeptide comprising an amino acid sequence as depicted in SEQ ID NO:4;
(b) a nucleic acid comprising a nucleotide sequence as depicted in SEQ ID NO: 3;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a method for assessing whether a patient suffers from essential thrombocythemia or is prone to suffering from essential thrombocythemia, said method comprising
   determining the presence of a gene product of one or more mutant alleles of the calreticulin gene in a sample from said patient; and
   assessing that said patient suffers from essential thrombocythemia or is prone to suffering from essential thrombocythemia when said gene product is present,
wherein said one or more mutant alleles comprises a nucleic acid encoding a mutant calreticulin protein as defined herein above,
wherein said gene product is selected from the group consisting of
(a) a nucleic acid encoding a polypeptide comprising an amino acid sequence as depicted in SEQ ID NO:4; and
(b) a nucleic acid comprising a nucleotide sequence as depicted in SEQ ID NO: 3.

The present invention relates to a method for assessing whether a patient suffers from a refractory anemia with ringed sideroblasts and thrombocythemia (RARS-T) or is prone to suffering from refractory anemia with ringed sideroblasts and thrombocythemia (RARS-T), said method comprising
   determining the presence of a gene product of one or more mutant alleles of the calreticulin gene in a sample from said patient; and
   assessing that said patient suffers from refractory anemia with ringed sideroblasts and thrombocythemia (RARS-T) or is prone to suffering from refractory anemia with ringed sideroblasts and thrombocythemia (RARS-T) when said gene product is present,
wherein said one or more mutant alleles comprises a nucleic acid encoding a mutant calreticulin protein as defined herein above,
wherein said gene product is selected from the group consisting of
(a) a nucleic acid encoding a polypeptide comprising an amino acid sequence as depicted in SEQ ID NO:4;
(b) a nucleic acid comprising a nucleotide sequence as depicted in SEQ ID NO: 3;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a method for assessing whether a patient suffers from a refractory anemia with ringed sideroblasts and thrombocythemia (RARS-T) or is prone to suffering from refractory anemia with ringed sideroblasts and thrombocythemia (RARS-T), said method comprising
   determining the presence of a gene product of one or more mutant alleles of the calreticulin gene in a sample from said patient; and
   assessing that said patient suffers from refractory anemia with ringed sideroblasts and thrombocythemia (RARS-T) or is prone to suffering from refractory anemia with ringed sideroblasts and thrombocythemia (RARS-T) when said gene product is present,
wherein said one or more mutant alleles comprises a nucleic acid encoding a mutant calreticulin protein as defined herein above,
wherein said gene product is selected from the group consisting of
(a) a nucleic acid encoding a polypeptide comprising an amino acid sequence as depicted in SEQ ID NO:4; and
(b) a nucleic acid comprising a nucleotide sequence as depicted in SEQ ID NO: 3.

Said gene product can comprise a nucleic acid selected from the group consisting of
(a) a nucleic acid encoding a polypeptide comprising an amino acid sequence as depicted in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(b) a nucleic acid comprising a nucleotide sequence as depicted in SEQ ID NO: 3, 7, 11, 15, 19, 23, 27, 31, 35, 39, 43, 47, 51, 55, 59, 63, 67, 71, 75, 79, 83, 87, 91, 95, 99, 103, 107, 111, 115, 119, 123, 127, 131, 135, 139, or 143;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a method for assessing whether a patient suffers from a primary myelofibrosis or is prone to suffering from primary myelofibrosis, said method comprising
   determining the presence of a gene product of one or more mutant alleles of the calreticulin gene in a sample from said patient; and
   assessing that said patient suffers from primary myelofibrosis or is prone to suffering from primary myelofibrosis when said gene product is present,
wherein said one or more mutant alleles comprises a nucleic acid encoding a mutant calreticulin protein as defined herein above,
wherein said gene product is selected from the group consisting of
(a) a nucleic acid encoding a polypeptide comprising an amino acid sequence as depicted in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(b) a nucleic acid comprising a nucleotide sequence as depicted in SEQ ID NO: 3, 7, 11, 15, 19, 23, 27, 31, 35, 39, 43, 47, 51, 55, 59, 63, 67, 71, 75, 79, 83, 87, 91, 95, 99, 103, 107, 111, 115, 119, 123, 127, 131, 135, 139, or 143;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a method for assessing whether a patient suffers from a primary myelofibrosis or is prone to suffering from primary myelofibrosis, said method comprising
   determining the presence of a gene product of one or more mutant alleles of the calreticulin gene in a sample from said patient; and assessing that said patient suffers from primary myelofibrosis or is prone to suffering from primary myelofibrosis when said gene product is present,
wherein said one or more mutant alleles comprises a nucleic acid encoding a mutant calreticulin protein as defined herein above,
wherein said gene product is selected from the group consisting of
(a) a nucleic acid encoding a polypeptide comprising an amino acid sequence as depicted in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144; and
(b) a nucleic acid comprising a nucleotide sequence as depicted in SEQ ID NO: 3, 7, 11, 15, 19, 23, 27, 31, 35, 39, 43, 47, 51, 55, 59, 63, 67, 71, 75, 79, 83, 87, 91, 95, 99, 103, 107, 111, 115, 119, 123, 127, 131, 135, 139, or 143.

The present invention relates to a method for assessing whether a patient suffers from essential thrombocythemia or is prone to suffering from essential thrombocythemia, said method comprising
determining the presence of a gene product of one or more mutant alleles of the calreticulin gene in a sample from said patient; and
assessing that said patient suffers from essential thrombocythemia or is prone to suffering from essential thrombocythemia when said gene product is present,
wherein said one or more mutant alleles comprises a nucleic acid encoding a mutant calreticulin protein as defined herein above,
wherein said gene product is selected from the group consisting of
(a) a nucleic acid encoding a polypeptide comprising an amino acid sequence as depicted in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(b) a nucleic acid comprising a nucleotide sequence as depicted in SEQ ID NO: 3, 7, 11, 15, 19, 23, 27, 31, 35, 39, 43, 47, 51, 55, 59, 63, 67, 71, 75, 79, 83, 87, 91, 95, 99, 103, 107, 111, 115, 119, 123, 127, 131, 135, 139, or 143;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a method for assessing whether a patient suffers from essential thrombocythemia or is prone to suffering from essential thrombocythemia, said method comprising
determining the presence of a gene product of one or more mutant alleles of the calreticulin gene in a sample from said patient; and
assessing that said patient suffers from essential thrombocythemia or is prone to suffering from essential thrombocythemia when said gene product is present,
wherein said one or more mutant alleles comprises a nucleic acid encoding a mutant calreticulin protein as defined herein above,
wherein said gene product is selected from the group consisting of
(a) a nucleic acid encoding a polypeptide comprising an amino acid sequence as depicted in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144; and
(b) a nucleic acid comprising a nucleotide sequence as depicted in SEQ ID NO: 3, 7, 11, 15, 19, 23, 27, 31, 35, 39, 43, 47, 51, 55, 59, 63, 67, 71, 75, 79, 83, 87, 91, 95, 99, 103, 107, 111, 115, 119, 123, 127, 131, 135, 139, or 143.

The present invention relates to a method for assessing whether a patient suffers from a refractory anemia with ringed sideroblasts and thrombocythemia (RARS-T) or is prone to suffering from refractory anemia with ringed sideroblasts and thrombocythemia (RARS-T), said method comprising
determining the presence of a gene product of one or more mutant alleles of the calreticulin gene in a sample from said patient; and
assessing that said patient suffers from refractory anemia with ringed sideroblasts and thrombocythemia (RARS-T) or is prone to suffering from refractory anemia with ringed sideroblasts and thrombocythemia (RARS-T) when said gene product is present,
wherein said one or more mutant alleles comprises a nucleic acid encoding a mutant calreticulin protein as defined herein above,
wherein said gene product is selected from the group consisting of
(a) a nucleic acid encoding a polypeptide comprising an amino acid sequence as depicted in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(b) a nucleic acid comprising a nucleotide sequence as depicted in SEQ ID NO: 3, 7, 11, 15, 19, 23, 27, 31, 35, 39, 43, 47, 51, 55, 59, 63, 67, 71, 75, 79, 83, 87, 91, 95, 99, 103, 107, 111, 115, 119, 123, 127, 131, 135, 139, or 143;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a method for assessing whether a patient suffers from a refractory anemia with ringed sideroblasts and thrombocythemia (RARS-T) or is prone to suffering from refractory anemia with ringed sideroblasts and thrombocythemia (RARS-T), said method comprising
determining the presence of a gene product of one or more mutant alleles of the calreticulin gene in a sample from said patient; and
assessing that said patient suffers from refractory anemia with ringed sideroblasts and thrombocythemia (RARS-T) or is prone to suffering from refractory anemia with ringed sideroblasts and thrombocythemia (RARS-T) when said gene product is present,
wherein said one or more mutant alleles comprises a nucleic acid encoding a mutant calreticulin protein as defined herein above,
wherein said gene product is selected from the group consisting of
(a) a nucleic acid encoding a polypeptide comprising an amino acid sequence as depicted in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144; and (b) a nucleic acid comprising a nucleotide sequence as depicted in SEQ ID NO: 3, 7, 11, 15, 19, 23, 27, 31, 35, 39, 43, 47, 51, 55, 59, 63, 67, 71, 75, 79, 83, 87, 91, 95, 99, 103, 107, 111, 115, 119, 123, 127, 131, 135, 139, or 143.

The gene product can comprise a nucleic acid selected from the group consisting of
(a) a nucleic acid encoding a polypeptide comprising an amino acid sequence as depicted in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;
(b) a nucleic acid comprising a nucleotide sequence as depicted in SEQ ID NO: 147, 151, 155, 159, 163, 167, 171, 175, 179, 183, 187, 191, 195, 199, 203, 207, 211, 215, 219, 223, 227, 231, 235, 239, 243, 247, 251, 255, 259, 263, 267, 271, 275, 279, 283, or 287;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a method for assessing whether a patient suffers from a primary myelofibrosis or is prone to suffering from primary myelofibrosis, said method comprising
    determining the presence of a gene product of one or more mutant alleles of the calreticulin gene in a sample from said patient; and
    assessing that said patient suffers from primary myelofibrosis or is prone to suffering from primary myelofibrosis when said gene product is present,
wherein said one or more mutant alleles comprises a nucleic acid encoding a mutant calreticulin protein as defined herein above,
wherein said gene product is selected from the group consisting of
(a) a nucleic acid encoding a polypeptide comprising an amino acid sequence as depicted in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;
(b) a nucleic acid comprising a nucleotide sequence as depicted in SEQ ID NO: 147, 151, 155, 159, 163, 167, 171, 175, 179, 183, 187, 191, 195, 199, 203, 207, 211, 215, 219, 223, 227, 231, 235, 239, 243, 247, 251, 255, 259, 263, 267, 271, 275, 279, 283, or 287;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a method for assessing whether a patient suffers from a primary myelofibrosis or is prone to suffering from primary myelofibrosis, said method comprising
    determining the presence of a gene product of one or more mutant alleles of the calreticulin gene in a sample from said patient; and
    assessing that said patient suffers from primary myelofibrosis or is prone to suffering from primary myelofibrosis when said gene product is present,
wherein said one or more mutant alleles comprises a nucleic acid encoding a mutant calreticulin protein as defined herein above,
wherein said gene product is selected from the group consisting of
(a) a nucleic acid encoding a polypeptide comprising an amino acid sequence as depicted in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288; and
(b) a nucleic acid comprising a nucleotide sequence as depicted in SEQ ID NO: 147, 151, 155, 159, 163, 167, 171, 175, 179, 183, 187, 191, 195, 199, 203, 207, 211, 215, 219, 223, 227, 231, 235, 239, 243, 247, 251, 255, 259, 263, 267, 271, 275, 279, 283, or 287.

The present invention relates to a method for assessing whether a patient suffers from essential thrombocythemia or is prone to suffering from essential thrombocythemia, said method comprising
    determining the presence of a gene product of one or more mutant alleles of the calreticulin gene in a sample from said patient; and
    assessing that said patient suffers from essential thrombocythemia or is prone to suffering from essential thrombocythemia when said gene product is present,
wherein said one or more mutant alleles comprises a nucleic acid encoding a mutant calreticulin protein as defined herein above,
wherein said gene product is selected from the group consisting of
(a) a nucleic acid encoding a polypeptide comprising an amino acid sequence as depicted in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;
(b) a nucleic acid comprising a nucleotide sequence as depicted in SEQ ID NO: 147, 151, 155, 159, 163, 167, 171, 175, 179, 183, 187, 191, 195, 199, 203, 207, 211, 215, 219, 223, 227, 231, 235, 239, 243, 247, 251, 255, 259, 263, 267, 271, 275, 279, 283, or 287;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a method for assessing whether a patient suffers from essential thrombocythemia or is prone to suffering from essential thrombocythemia, said method comprising
    determining the presence of a gene product of one or more mutant alleles of the calreticulin gene in a sample from said patient; and
    assessing that said patient suffers from essential thrombocythemia or is prone to suffering from essential thrombocythemia when said gene product is present,
wherein said one or more mutant alleles comprises a nucleic acid encoding a mutant calreticulin protein as defined herein above,
wherein said gene product is selected from the group consisting of (a) a nucleic acid encoding a polypeptide comprising an amino acid sequence as depicted in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288; and
(b) a nucleic acid comprising a nucleotide sequence as depicted in SEQ ID NO: 147, 151, 155, 159, 163, 167, 171, 175, 179, 183, 187, 191, 195, 199, 203, 207, 211, 215, 219, 223, 227, 231, 235, 239, 243, 247, 251, 255, 259, 263, 267, 271, 275, 279, 283, or 287.

The present invention relates to a method for assessing whether a patient suffers from a refractory anemia with ringed sideroblasts and thrombocythemia (RARS-T) or is prone to suffering from refractory anemia with ringed sideroblasts and thrombocythemia (RARS-T), said method comprising
    determining the presence of a gene product of one or more mutant alleles of the calreticulin gene in a sample from said patient; and
    assessing that said patient suffers from refractory anemia with ringed sideroblasts and thrombocythemia (RARS-T) or is prone to suffering from refractory anemia with ringed sideroblasts and thrombocythemia (RARS-T) when said gene product is present,
wherein said one or more mutant alleles comprises a nucleic acid encoding a mutant calreticulin protein as defined herein above,
wherein said gene product is selected from the group consisting of
(a) a nucleic acid encoding a polypeptide comprising an amino acid sequence as depicted in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;
(b) a nucleic acid comprising a nucleotide sequence as depicted in SEQ ID NO: 147, 151, 155, 159, 163, 167, 171, 175, 179, 183, 187, 191, 195, 199, 203, 207, 211, 215, 219, 223, 227, 231, 235, 239, 243, 247, 251, 255, 259, 263, 267, 271, 275, 279, 283, or 287;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a method for assessing whether a patient suffers from a refractory anemia with ringed sideroblasts and thrombocythemia (RARS-T) or is prone to suffering from refractory anemia with ringed sideroblasts and thrombocythemia (RARS-T), said method comprising
    determining the presence of a gene product of one or more mutant alleles of the calreticulin gene in a sample from said patient; and
    assessing that said patient suffers from refractory anemia with ringed sideroblasts and thrombocythemia (RARS-T) or is prone to suffering from refractory anemia with ringed sideroblasts and thrombocythemia (RARS-T) when said gene product is present,
wherein said one or more mutant alleles comprises a nucleic acid encoding a mutant calreticulin protein as defined herein above,
wherein said gene product is selected from the group consisting of
(a) a nucleic acid encoding a polypeptide comprising an amino acid sequence as depicted in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288; and
(b) a nucleic acid comprising a nucleotide sequence as depicted in SEQ ID NO: 147, 151, 155, 159, 163, 167, 171, 175, 179, 183, 187, 191, 195, 199, 203, 207, 211, 215, 219, 223, 227, 231, 235, 239, 243, 247, 251, 255, 259, 263, 267, 271, 275, 279, 283, or 287.

The gene product can comprise a nucleic acid selected from the group consisting of
(a) a nucleic acid encoding a polypeptide comprising an amino acid sequence as depicted in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
(b) a nucleic acid comprising a nucleotide sequence as depicted in SEQ ID NO: 293, 297, 301, 305, 309, 313, 317, 321, 325, 329, 333, 337, 341, 345, 349, 353, 357, 361, 365, 369, 373, 377, 381, 385, 389, 393, 397, 401, 405, 409, 413, 417, 421, 425, 429, or 433;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a method for assessing whether a patient suffers from a primary myelofibrosis or is prone to suffering from primary myelofibrosis, said method comprising
    determining the presence of a gene product of one or more mutant alleles of the calreticulin gene in a sample from said patient; and
    assessing that said patient suffers from primary myelofibrosis or is prone to suffering from primary myelofibrosis when said gene product is present,
wherein said one or more mutant alleles comprises a nucleic acid encoding a mutant calreticulin protein as defined herein above,
wherein said gene product is selected from the group consisting of
(a) a nucleic acid encoding a polypeptide comprising an amino acid sequence as depicted in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
(b) a nucleic acid comprising a nucleotide sequence as depicted in SEQ ID NO: 293, 297, 301, 305, 309, 313, 317, 321, 325, 329, 333, 337, 341, 345, 349, 353, 357, 361, 365, 369, 373, 377, 381, 385, 389, 393, 397, 401, 405, 409, 413, 417, 421, 425, 429, or 433;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a method for assessing whether a patient suffers from a primary myelofibrosis or is prone to suffering from primary myelofibrosis, said method comprising determining the presence of a gene product of one or more mutant alleles of the calreticulin gene in a sample from said patient; and assessing that said patient suffers from primary myelofibrosis or is prone to suffering from primary myelofibrosis when said gene product is present, wherein said one or more mutant alleles comprises a nucleic acid encoding a mutant calreticulin protein as defined herein above, wherein said gene product is selected from the group consisting of (a) a nucleic acid encoding a polypeptide comprising an amino acid sequence as depicted in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434; and (b) a nucleic acid comprising a nucleotide sequence as depicted in SEQ ID NO: 293, 297, 301, 305, 309, 313, 317, 321, 325, 329, 333, 337, 341, 345, 349, 353, 357, 361, 365, 369, 373, 377, 381, 385, 389, 393, 397, 401, 405, 409, 413, 417, 421, 425, 429, or 433.

The present invention relates to a method for assessing whether a patient suffers from essential thrombocythemia or is prone to suffering from essential thrombocythemia, said method comprising determining the presence of a gene product of one or more mutant alleles of the calreticulin gene in a sample from said patient; and assessing that said patient suffers from essential thrombocythemia or is prone to suffering from essential thrombocythemia when said gene product is present, wherein said one or more mutant alleles comprises a nucleic acid encoding a mutant calreticulin protein as defined herein above, wherein said gene product is selected from the group consisting of (a) a nucleic acid encoding a polypeptide comprising an amino acid sequence as depicted in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;

(b) a nucleic acid comprising a nucleotide sequence as depicted in SEQ ID NO: 293, 297, 301, 305, 309, 313, 317, 321, 325, 329, 333, 337, 341, 345, 349, 353, 357, 361, 365, 369, 373, 377, 381, 385, 389, 393, 397, 401, 405, 409, 413, 417, 421, 425, 429, or 433;

(c) a nucleic acid hybridizing under stringent conditions to the complementary strand of the nucleic acid as defined in (a) or (b);

(d) a nucleic acid comprising a nucleotide sequence with at least 70% identity to the nucleotide sequence of the nucleic acids of any one of (a) to (c); and (e) a nucleic acid comprising a nucleotide sequence which is degenerate as a result of the genetic code to the nucleotide sequence of a nucleic acid of any one of (a) to (d).

The present invention relates to a method for assessing whether a patient suffers from essential thrombocythemia or is prone to suffering from essential thrombocythemia, said method comprising determining the presence of a gene product of one or more mutant alleles of the calreticulin gene in a sample from said patient; and assessing that said patient suffers from essential thrombocythemia or is prone to suffering from essential thrombocythemia when said gene product is present, wherein said one or more mutant alleles comprises a nucleic acid encoding a mutant calreticulin protein as defined herein above, wherein said gene product is selected from the group consisting of (a) a nucleic acid encoding a polypeptide comprising an amino acid sequence as depicted in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434; and (b) a nucleic acid comprising a nucleotide sequence as depicted in SEQ ID NO: 293, 297, 301, 305, 309, 313, 317, 321, 325, 329, 333, 337, 341, 345, 349, 353, 357, 361, 365, 369, 373, 377, 381, 385, 389, 393, 397, 401, 405, 409, 413, 417, 421, 425, 429, or 433.

The present invention relates to a method for assessing whether a patient suffers from a refractory anemia with ringed sideroblasts and thrombocythemia (RARS-T) or is prone to suffering from refractory anemia with ringed sideroblasts and thrombocythemia (RARS-T), said method comprising determining the presence of a gene product of one or more mutant alleles of the calreticulin gene in a sample from said patient; and assessing that said patient suffers from refractory anemia with ringed sideroblasts and thrombocythemia (RARS-T) or is prone to suffering from refractory anemia with ringed sideroblasts and thrombocythemia (RARS-T) when said gene product is present, wherein said one or more mutant alleles comprises a nucleic acid encoding a mutant calreticulin protein as defined herein above, wherein said gene product is selected from the group consisting of (a) a nucleic acid encoding a polypeptide comprising an amino acid sequence as depicted in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;

(b) a nucleic acid comprising a nucleotide sequence as depicted in SEQ ID NO: 293, 297, 301, 305, 309, 313, 317, 321, 325, 329, 333, 337, 341, 345, 349, 353, 357, 361, 365, 369, 373, 377, 381, 385, 389, 393, 397, 401, 405, 409, 413, 417, 421, 425, 429, or 433;

(c) a nucleic acid hybridizing under stringent conditions to the complementary strand of the nucleic acid as defined in (a) or (b);

(d) a nucleic acid comprising a nucleotide sequence with at least 70% identity to the nucleotide sequence of the nucleic acids of any one of (a) to (c); and (e) a nucleic acid comprising a nucleotide sequence which is degenerate as a result of the genetic code to the nucleotide sequence of a nucleic acid of any one of (a) to (d).

The present invention relates to a method for assessing whether a patient suffers from a refractory anemia with ringed sideroblasts and thrombocythemia (RARS-T) or is prone to suffering from refractory anemia with ringed sideroblasts and thrombocythemia (RARS-T), said method comprising determining the presence of a gene product of one or more mutant alleles of the calreticulin gene in a sample from said patient; and assessing that said patient suffers from refractory anemia with ringed sideroblasts and thrombocythemia (RARS-T) or is prone to suffering from refractory anemia with ringed sideroblasts and thrombocythemia (RARS-T) when said gene product is present, wherein said one or more mutant alleles comprises a nucleic acid encoding a mutant calreticulin protein as defined herein above,
wherein said gene product is selected from the group consisting of
(a) a nucleic acid encoding a polypeptide comprising an amino acid sequence as depicted in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434; and
(b) a nucleic acid comprising a nucleotide sequence as depicted in SEQ ID NO: 293, 297, 301, 305, 309, 313, 317, 321, 325, 329, 333, 337, 341, 345, 349, 353, 357, 361, 365, 369, 373, 377, 381, 385, 389, 393, 397, 401, 405, 409, 413, 417, 421, 425, 429, or 433.

If the gene product is mRNA, the presence or amount of said mRNA can be determined by routine techniques, such as RealTime PCR, ReverseTranscriptase PCR, Whole Transcriptome Shotgun Sequencing (RNAseq), sanger sequencing, in situ hybridization or micro-arrays.

Accordingly, the determination by PCR techniques such as RealTime PCR or ReverseTranscriptase PCR can further comprise the steps
(i) contacting the nucleic acid in the sample with one or two oligonucleotides; and
(ii) generating an amplification product containing the target sequence.

Exemplary mutation specific probes and primers are provided and used herein.

Exemplary oligonucleotides (primers) to be used in accordance with the present invention are

```
Forward:
ACAACTTCCTCATCACCAACG       (SEQ ID NO: 437)
and/or

Reverse:
GGCCTCAGTCCAGCCCTG          (SEQ ID NO: 438)

Forward:
GGCAAGGCCCTGAGGTGT          (SEQ ID NO: 439)
and/or

Reverse:
GGCCTCAGTCCAGCCCTG          (SEQ ID NO: 438)
```

Further suitable mutation specific probes and primers for use in the present invention can, for example, be derived from the cDNA sequences of the mutated calreticulin gene. Such cDNA sequences are provided and described below. Exemplary cDNA sequences that can be used in this context are shown in SEQ ID NO: 2, 6, 10, 14, 18, 22, 26, 30, 34, 38, 42, 46, 50, 54, 58, 62, 66, 70, 74, 78, 82, 86, 90, 94, 98, 102, 106, 110, 114, 118, 122, 126, 130, 134, 138, 142, 146, 150, 154, 158, 162, 166, 170, 174, 178, 182, 186, 190, 194, 198, 202, 206, 210, 214, 218, 222, 226, 230, 234, 238, 242, 246, 250, 254, 258, 262, 266, 270, 274, 278, 282, or 286; 292, 296, 300, 304, 308, 312, 316, 320, 324, 328, 332, 336, 340, 344, 348, 352, 356, 360, 364, 368, 372, 376, 380, 384, 388, 392, 396, 400, 404, 408, 412, 416, 420, 424, 428, or 432.

Further exemplary cDNA sequences that can be used for the design of mutation specific probes and primers are depicted in the following TABLE 1:

TABLE 1

Sequences of mutation junctions in the cDNA sequence of CALR for the design of mutation specific probes or PCR primers.

CALR
mutation cDNA junction sequences in mutated positions

Type 1   GAAGGACAAACAGGACGAGGAGCAGAGGACAAGGAGGATGAT
         (SEQ ID NO: 440)

Type 2   GAGGAGGAGGCAGAGGACAA<u>TTGTC</u>GGAGGATGATGAGGACAAAG
         (SEQ ID NO: 441)

Type 3   GGACAAACAGGACGAGGAGCAGAGGCAGAGGACAAGGAGGAT
         (SEQ ID NO: 442)

Type 4   CAGGACGAGGAGCAGAGGCTTAGGAGGAGGCAGAGGACAAGG
         (SEQ ID NO: 443)

Type 5   TGAAGGACAAACAGGACGAGGGGCAGAGGACAAGGAGGATGA
         (SEQ ID NO: 444)

Type 6   AGGACAAACAGGACGAGGAGCGGAGGCAGAGGACAAGGAGGA
         (SEQ ID NO: 445)

Type 7   CAGGACGAGGAGCAGAGGCTTAGGAGGATGATGAGGACAAAG
         (SEQ ID NO: 446)

Type 8   GGACGAGGAGCAGAGGCTTAAGAGGAGGCAGAGGACAAGGAG
         (SEQ ID NO: 447)

Type 9   CAAGAAACGCAAAGAGGAGGAGAGGCAGAGGACAAGGAGGAT
         (SEQ ID NO: 448)

Type 10  AGGAGGAGGAGGCAGAGGACA<u>TGTGTC</u>GGAGGATGATGAGGACAAAG
         (SEQ ID NO: 449)

Type 11  AAGGACAAACAGGACGAGGA*C*CAGAGGCAGAGGACAAGGAGGAT
         (SEQ ID NO: 450)

Type 12  CAAACAGGACGAGGAGCAGAGGAGGAGGAGGAGGCAGAGGAC
         (SEQ ID NO: 451)

TABLE 1-continued

Sequences of mutation junctions in the cDNA sequence of CALR
for the design of mutation specific probes or PCR primers.

CALR
mutation cDNA junction sequences in mutated positions

Type 13 AACAGGACGAGGAGCAGAGGCAGAGGAGGAGGCAGAGGACAAG
        (SEQ ID NO: 452)

Type 14 ACAGGACGAGGAGCAGAGGCTGAGGAGGAGGCAGAGGACAAG
        (SEQ ID NO: 453)

Type 15 CAGGACGAGGAGCAGAGGCTTAGGAGGAGGAGAGGACAAGGAGGATGATG
        (SEQ ID NO: 454)

Type 16 CAGGACGAGGAGCAGAGGCTTCAGAGGAGGCAGAGGACAAGGAG
        (SEQ ID NO: 455)

Type 17 GGACGAGGAGCAGAGGCTTAAGAGGAGGCAGTGGACAAGGAGGATGATGAGG
        (SEQ ID NO: 456)

Type 18 GGACGAGGAGCAGAGGCTTAAGAGGATGATGAGGACAAAGAT
        (SEQ ID NO: 457)

Type 19 GGAGCAGAGGCTTAAGGAGGAGAGGCAGAGGACAAGGAGGAT
        (SEQ ID NO: 458)

Type 20 GGCTTAAGGAGGAGGAAGAAGGGGAGGAGGCAGAGGACAAGGA
        (SEQ ID NO: 459)

Type 21 GGCTTAAGGAGGAGGAAGAAGCGTTTAAGAGGACAAGGAGGATGATGA
        (SEQ ID NO: 460)

Type 22 CTTAAGGAGGAGGAAGAAGACAACGCAAAGAGGAGGAGGAGG
        (SEQ ID NO: 461)

Type 23 CTTAAGGAGGAGGAAGAAGACTGCGTGAGGAGGAGGAGGCAGAGGAC
        (SEQ ID NO: 462)

Type 24 CTTAAGGAGGAGGAAGAAGACAGGAGGCAGAGGACAAGGAGG
        (SEQ ID NO: 463)

Type 25 TAAGGAGGAGGAAGAAGACAAAAGGCAGAGGACAAGGAGGATG
        (SEQ ID NO: 464)

Type 26 TAAGGAGGAGGAAGAAGACAAAAACGCAAAGAGGAGGAGGAG
        (SEQ ID NO: 465)

Type 27 AAGGAGGAGGAAGAAGACAAGTGTTTCGCAAAGAGGAGGAGGAGGCA
        (SEQ ID NO: 466)

Type 28 GGAAGAAGACAAGAAACGCAAAGGAGGATGATGAGGACAAA
        (SEQ ID NO: 467)

Type 29 GAAGACAAGAAACGCAAAGAGCCTCCTCTTTGTCTAAGGAGGATGATGAGGACAAA
        (SEQ ID NO: 468)

Type 30 AGACAAGAAACGCAAAGAGGACCATCCTTGTCGGAGGATGATGAGGACAAAGA
        (SEQ ID NO: 469)

Type 31 AGAGGAGGAGGAGGCAGAGGCAATTGTCGGAGGATGATGAGGACAAAG
        (SEQ ID NO: 470)

Type 32 GAGGAGGAGGAGGCAGAGGACTGTCGGAGGATGATGAGGACAAAGA
        (SEQ ID NO: 471)

Type 33 GAGGAGGAGGCAGAGGACAAATGTCGGAGGATGATGAGGACAAAG
        (SEQ ID NO: 472)

Type 34 AGGAGGAGGAGGCAGAGGACACTTGTCGGAGGATGATGAGGACAAAGA
        (SEQ ID NO: 473)

Type 35 AGGAGGAGGAGGCAGAGGACATTTGTCGGAGGATGATGAGGACAAAGA
        (SEQ ID NO: 474)

TABLE 1-continued

Sequences of mutation junctions in the cDNA sequence of CALR
for the design of mutation specific probes or PCR primers.

CALR
mutation cDNA junction sequences in mutated positions

Type 36  AGGAGGAGGCAGAGGACAAG<u>TGTCG</u>GAGGATGATGAGGACAAAGA
         (SEQ ID NO: 475)

Bold letters indicate the borders of a deletion event; underlined letters indicate inserted sequences; Bold and italic letters indicate single nucleotide variants The following relates to embodiments, wherein the gene product is a protein/polypeptide.

The gene product can comprise a polypeptide selected from the group consisting of
a) a protein encoded by a nucleic acid molecule having the nucleic acid sequence as depicted in SEQ ID NO: 1, 2 or 3;
(b) a protein comprising the amino acid sequence as shown in SEQ ID NO: 4;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 4;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from a primary myelofibrosis or is prone to suffering from primary myelofibrosis, said method comprising
    determining the presence of a gene product of one or more mutant alleles of the calreticulin gene in a sample from said patient; and
    assessing that said patient suffers from primary myelofibrosis or is prone to suffering from primary myelofibrosis when said gene product is present,
wherein said one or more mutant alleles comprises a nucleic acid encoding a mutant calreticulin protein as defined herein above,
wherein said gene product is selected from the group consisting of
a) a protein encoded by a nucleic acid molecule having the nucleic acid sequence as depicted in SEQ ID NO: 1, 2 or 3;
(b) a protein comprising the amino acid sequence as shown in SEQ ID NO: 4;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 4;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from a primary myelofibrosis or is prone to suffering from primary myelofibrosis, said method comprising
    determining the presence of a gene product of one or more mutant alleles of the calreticulin gene in a sample from said patient; and
    assessing that said patient suffers from primary myelofibrosis or is prone to suffering from primary myelofibrosis when said gene product is present,
wherein said one or more mutant alleles comprises a nucleic acid encoding a mutant calreticulin protein as defined herein above,
wherein said gene product is selected from the group consisting of
a) a protein encoded by a nucleic acid molecule having the nucleic acid sequence as depicted in SEQ ID NO: 1, 2 or 3;
(b) a protein comprising the amino acid sequence as shown in SEQ ID NO: 4.

The present invention relates to a method for assessing whether a patient suffers from essential thrombocythemia or is prone to suffering from essential thrombocythemia, said method comprising
    determining the presence of a gene product of one or more mutant alleles of the calreticulin gene in a sample from said patient; and
    assessing that said patient suffers from essential thrombocythemia or is prone to suffering from essential thrombocythemia when said gene product is present,
wherein said one or more mutant alleles comprises a nucleic acid encoding a mutant calreticulin protein as defined herein above,
wherein said gene product is selected from the group consisting of
a) a protein encoded by a nucleic acid molecule having the nucleic acid sequence as depicted in SEQ ID NO: 1, 2 or 3;
(b) a protein comprising the amino acid sequence as shown in SEQ ID NO: 4;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 4;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and (g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from essential thrombocythemia or is prone to suffering from essential thrombocythemia, said method comprising determining the presence of a gene product of one or more mutant alleles of the calreticulin gene in a sample from said patient; and assessing that said patient suffers from essential thrombocythemia or is prone to suffering from essential thrombocythemia when said gene product is present, wherein said one or more mutant alleles comprises a nucleic acid encoding a mutant calreticulin protein as defined herein above, wherein said gene product is selected from the group consisting of a) a protein encoded by a nucleic acid molecule having the nucleic acid sequence as depicted in SEQ ID NO: 1, 2 or 3; and (b) a protein comprising the amino acid sequence as shown in SEQ ID NO: 4.

The present invention relates to a method for assessing whether a patient suffers from a refractory anemia with ringed sideroblasts and thrombocythemia (RARS-T) or is prone to suffering from refractory anemia with ringed sideroblasts and thrombocythemia (RARS-T), said method comprising determining the presence of a gene product of one or more mutant alleles of the calreticulin gene in a sample from said patient; and assessing that said patient suffers from refractory anemia with ringed sideroblasts and thrombocythemia (RARS-T) or is prone to suffering from refractory anemia with ringed sideroblasts and thrombocythemia (RARS-T) when said gene product is present, wherein said one or more mutant alleles comprises a nucleic acid encoding a mutant calreticulin protein as defined herein above, wherein said gene product is selected from the group consisting of a) a protein encoded by a nucleic acid molecule having the nucleic acid sequence as depicted in SEQ ID NO: 1, 2 or 3;
(b) a protein comprising the amino acid sequence as shown in SEQ ID NO: 4;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 4;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from a refractory anemia with ringed sideroblasts and thrombocythemia (RARS-T) or is prone to suffering from refractory anemia with ringed sideroblasts and thrombocythemia (RARS-T), said method comprising determining the presence of a gene product of one or more mutant alleles of the calreticulin gene in a sample from said patient; and assessing that said patient suffers from refractory anemia with ringed sideroblasts and thrombocythemia (RARS-T) or is prone to suffering from refractory anemia with ringed sideroblasts and thrombocythemia (RARS-T) when said gene product is present, wherein said one or more mutant alleles comprises a nucleic acid encoding a mutant calreticulin protein as defined herein above, wherein said gene product is selected from the group consisting of a) a protein encoded by a nucleic acid molecule having the nucleic acid sequence as depicted in SEQ ID NO: 1, 2 or 3; and (b) a protein comprising the amino acid sequence as shown in SEQ ID NO: 4.

The gene product can comprise a polypeptide selected from the group consisting of (a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, or 143;
(b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from a primary myelofibrosis or is prone to suffering from primary myelofibrosis, said method comprising determining the presence of a gene product of one or more mutant alleles of the calreticulin gene in a sample from said patient; and assessing that said patient suffers from primary myelofibrosis or is prone to suffering from primary myelofibrosis when said gene product is present, wherein said one or more mutant alleles comprises a nucleic acid encoding a mutant calreticulin protein as defined herein above, wherein said gene product is a polypeptide selected from the group consisting of (a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, or 143;

(b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;

(c) a protein as defined in (a) or (b) wherein one or more amino acids are deleted, inserted, added or substituted;

(d) a protein encoded by a nucleic acid molecule encoding a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;

(e) a protein comprising an amino acid sequence encoded by a nucleic acid hybridizing under stringent conditions to the complementary strand of nucleic acid molecules as defined in (a) or (c);

(f) a protein having at least 70% identity to the protein of any one of (a) to (e); and (g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from a primary myelofibrosis or is prone to suffering from primary myelofibrosis, said method comprising
  determining the presence of a gene product of one or more mutant alleles of the calreticulin gene in a sample from said patient; and
  assessing that said patient suffers from primary myelofibrosis or is prone to suffering from primary myelofibrosis when said gene product is present,
wherein said one or more mutant alleles comprises a nucleic acid encoding a mutant calreticulin protein as defined herein above,
wherein said gene product is a polypeptide selected from the group consisting of
(a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, or 143; and (b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144.

The present invention relates to a method for assessing whether a patient suffers from essential thrombocythemia or is prone to suffering from essential thrombocythemia, said method comprising
  determining the presence of a gene product of one or more mutant alleles of the calreticulin gene in a sample from said patient; and
  assessing that said patient suffers from essential thrombocythemia or is prone to suffering from essential thrombocythemia when said gene product is present,
wherein said one or more mutant alleles comprises a nucleic acid encoding a mutant calreticulin protein as defined herein above,
wherein said gene product is a polypeptide selected from the group consisting of
(a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, or 143;

(b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;

(c) a protein as defined in (a) or (b) wherein one or more amino acids are deleted, inserted, added or substituted;

(d) a protein encoded by a nucleic acid molecule encoding a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;

(e) a protein comprising an amino acid sequence encoded by a nucleic acid hybridizing under stringent conditions to the complementary strand of nucleic acid molecules as defined in (a) or (c);

(f) a protein having at least 70% identity to the protein of any one of (a) to (e); and (g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from essential thrombocythemia or is prone to suffering from essential thrombocythemia, said method comprising
  determining the presence of a gene product of one or more mutant alleles of the calreticulin gene in a sample from said patient; and
  assessing that said patient suffers from essential thrombocythemia or is prone to suffering from essential thrombocythemia when said gene product is present,
wherein said one or more mutant alleles comprises a nucleic acid encoding a mutant calreticulin protein as defined herein above,
wherein said gene product is a polypeptide selected from the group consisting of
(a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, or 143; and (b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144.

The present invention relates to a method for assessing whether a patient suffers from a refractory anemia with ringed sideroblasts and thrombocythemia (RARS-T) or is prone to suffering from refractory anemia with ringed sideroblasts and thrombocythemia (RARS-T), said method comprising determining the presence of a gene product of one or more mutant alleles of the calreticulin gene in a sample from said patient; and assessing that said patient suffers from refractory anemia with ringed sideroblasts and thrombocythemia (RARS-T) or is prone to suffering from refractory anemia with ringed sideroblasts and thrombocythemia (RARS-T) when said gene product is present, wherein said one or more mutant alleles comprises a nucleic acid encoding a mutant calreticulin protein as defined herein above, wherein said gene product is selected from the group consisting of (a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, or 143;

(b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;

(c) a protein as defined in (a) or (b) wherein one or more amino acids are deleted, inserted, added or substituted;

(d) a protein encoded by a nucleic acid molecule encoding a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;

(e) a protein comprising an amino acid sequence encoded by a nucleic acid hybridizing under stringent conditions to the complementary strand of nucleic acid molecules as defined in (a) or (c);

(f) a protein having at least 70% identity to the protein of any one of (a) to (e); and (g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from a refractory anemia with ringed sideroblasts and thrombocythemia (RARS-T) or is prone to suffering from refractory anemia with ringed sideroblasts and thrombocythemia (RARS-T), said method comprising determining the presence of a gene product of one or more mutant alleles of the calreticulin gene in a sample from said patient; and assessing that said patient suffers from refractory anemia with ringed sideroblasts and thrombocythemia (RARS-T) or is prone to suffering from refractory anemia with ringed sideroblasts and thrombocythemia (RARS-T) when said gene product is present, wherein said one or more mutant alleles comprises a nucleic acid encoding a mutant calreticulin protein as defined herein above, wherein said gene product is selected from the group consisting of (a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, or 143; and (b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144.

The gene product can comprise a polypeptide selected from the group consisting of (a) a protein encoded by a nucleic acid molecule having the nucleic acid sequence as depicted in SEQ ID NO: 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, or 287;

(b) a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;

(c) a protein as defined in (a) or (b) wherein one or more amino acids are deleted, inserted, added or substituted;

(d) a protein encoded by a nucleic acid molecule encoding a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;

(e) a protein comprising an amino acid sequence encoded by a nucleic acid hybridizing under stringent conditions to the complementary strand of nucleic acid molecules as defined in (a) or (c);

(f) a protein having at least 70% identity to the protein of any one of (a) to (e); and (g) a protein comprising an amino acid sequence encoded by a nucleic acid being degenerate as a result of the genetic code to the nucleotide sequence of a nucleic acid as defined in (a), (d) or (e).

(f) a protein having at least 70% identity to the protein of any one of (a) to (e); and (g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from a primary myelofibrosis or is prone to suffering from primary myelofibrosis, said method comprising determining the presence of a gene product of one or more mutant alleles of the calreticulin gene in a sample from said patient; and assessing that said patient suffers from primary myelofibrosis or is prone to suffering from primary myelofibrosis when said gene product is present, wherein said one or more mutant alleles comprises a nucleic acid encoding a mutant calreticulin protein as defined herein above, wherein said gene product is selected from the group consisting of (a) a protein encoded by a nucleic acid molecule having the nucleic acid sequence as depicted in SEQ ID NO: 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, or 287;

(b) a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;

(c) a protein as defined in (a) or (b) wherein one or more amino acids are deleted, inserted, added or substituted;

(d) a protein encoded by a nucleic acid molecule encoding a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;

(e) a protein comprising an amino acid sequence encoded by a nucleic acid hybridizing under stringent conditions to the complementary strand of nucleic acid molecules as defined in (a) or (c);

(f) a protein having at least 70% identity to the protein of any one of (a) to (e); and (g) a protein comprising an amino acid sequence encoded by a nucleic acid being degenerate as a result of the genetic code to the nucleotide sequence of a nucleic acid as defined in (a), (d) or (e).

(f) a protein having at least 70% identity to the protein of any one of (a) to (e); and (g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from a primary myelofibrosis or is prone to suffering from primary myelofibrosis, said method comprising
determining the presence of a gene product of one or more mutant alleles of the calreticulin gene in a sample from said patient; and
assessing that said patient suffers from primary myelofibrosis or is prone to suffering from primary myelofibrosis when said gene product is present,
wherein said one or more mutant alleles comprises a nucleic acid encoding a mutant calreticulin protein as defined herein above,
wherein said gene product is selected from the group consisting of
(a) a protein encoded by a nucleic acid molecule having the nucleic acid sequence as depicted in SEQ ID NO: 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, or 287;

(b) a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;

(c) a protein as defined in (a) or (b) wherein one or more amino acids are deleted, inserted, added or substituted; and (d) a protein encoded by a nucleic acid molecule encoding a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288.

The present invention relates to a method for assessing whether a patient suffers from essential thrombocythemia or is prone to suffering from essential thrombocythemia, said method comprising
determining the presence of a gene product of one or more mutant alleles of the calreticulin gene in a sample from said patient; and
assessing that said patient suffers from essential thrombocythemia or is prone to suffering from essential thrombocythemia when said gene product is present,
wherein said one or more mutant alleles comprises a nucleic acid encoding a mutant calreticulin protein as defined herein above,
wherein said gene product is selected from the group consisting of
(a) a protein encoded by a nucleic acid molecule having the nucleic acid sequence as depicted in SEQ ID NO: 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, or 287;

(b) a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;

(c) a protein as defined in (a) or (b) wherein one or more amino acids are deleted, inserted, added or substituted;

(d) a protein encoded by a nucleic acid molecule encoding a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;

(e) a protein comprising an amino acid sequence encoded by a nucleic acid hybridizing under stringent conditions to the complementary strand of nucleic acid molecules as defined in (a) or (c);

(f) a protein having at least 70% identity to the protein of any one of (a) to (e); and (g) a protein comprising an amino acid sequence encoded by a nucleic acid being degenerate as a result of the genetic code to the nucleotide sequence of a nucleic acid as defined in (a), (d) or (e).

(f) a protein having at least 70% identity to the protein of any one of (a) to (e); and (g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from essential thrombocythemia or is prone to suffering from essential thrombocythemia, said method comprising determining the presence of a gene product of one or more mutant alleles of the calreticulin gene in a sample from said patient; and assessing that said patient suffers from essential thrombocythemia or is prone to suffering from essential thrombocythemia when said gene product is present, wherein said one or more mutant alleles comprises a nucleic acid encoding a mutant calreticulin protein as defined herein above, wherein said gene product is selected from the group consisting of (a) a protein encoded by a nucleic acid molecule having the nucleic acid sequence as depicted in SEQ ID NO: 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, or 287; and (b) a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288.

The present invention relates to a method for assessing whether a patient suffers from a refractory anemia with ringed sideroblasts and thrombocythemia (RARS-T) or is prone to suffering from refractory anemia with ringed sideroblasts and thrombocythemia (RARS-T), said method comprising determining the presence of a gene product of one or more mutant alleles of the calreticulin gene in a sample from said patient; and assessing that said patient suffers from refractory anemia with ringed sideroblasts and thrombocythemia (RARS-T) or is prone to suffering from refractory anemia with ringed sideroblasts and thrombocythemia (RARS-T) when said gene product is present, wherein said one or more mutant alleles comprises a nucleic acid encoding a mutant calreticulin protein as defined herein above, wherein said gene product is selected from the group consisting of (a) a protein encoded by a nucleic acid molecule having the nucleic acid sequence as depicted in SEQ ID NO: 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, or 287; and (b) a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;

(c) a protein as defined in (a) or (b) wherein one or more amino acids are deleted, inserted, added or substituted;

(d) a protein encoded by a nucleic acid molecule encoding a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;

(e) a protein comprising an amino acid sequence encoded by a nucleic acid hybridizing under stringent conditions to the complementary strand of nucleic acid molecules as defined in (a) or (c);

(f) a protein having at least 70% identity to the protein of any one of (a) to (e); and (g) a protein comprising an amino acid sequence encoded by a nucleic acid being degenerate as a result of the genetic code to the nucleotide sequence of a nucleic acid as defined in (a), (d) or (e).

(f) a protein having at least 70% identity to the protein of any one of (a) to (e); and (g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from a refractory anemia with ringed sideroblasts and thrombocythemia (RARS-T) or is prone to suffering from refractory anemia with ringed sideroblasts and thrombocythemia (RARS-T), said method comprising determining the presence of a gene product of one or more mutant alleles of the calreticulin gene in a sample from said patient; and assessing that said patient suffers from refractory anemia with ringed sideroblasts and thrombocythemia (RARS-T) or is prone to suffering from refractory anemia with ringed sideroblasts and thrombocythemia (RARS-T) when said gene product is present, wherein said one or more mutant alleles comprises a nucleic acid encoding a mutant calreticulin protein as defined herein above, wherein said gene product is selected from the group consisting of a) a protein encoded by a nucleic acid molecule having the nucleic acid sequence as depicted in SEQ ID NO: 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, or 287; and (b) a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288.

The gene product can comprise a polypeptide selected from the group consisting of (a) a protein encoded by a nucleic acid molecule having the nucleic acid sequence as depicted in SEQ ID NO: 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433;

(b) a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;

(c) a protein as defined in (a) or (b) wherein one or more amino acids are deleted, inserted, added or substituted;

(d) a protein encoded by a nucleic acid molecule encoding a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;

(e) a protein comprising an amino acid sequence encoded by a nucleic acid hybridizing under stringent conditions to the complementary strand of nucleic acid molecules as defined in (a) or (c);

(f) a protein having at least 70% identity to the protein of any one of (a) to (e); and (g) a protein comprising an amino acid sequence encoded by a nucleic acid being degenerate as a result of the genetic code to the nucleotide sequence of a nucleic acid as defined in (a), (d) or (e).

(f) a protein having at least 70% identity to the protein of any one of (a) to (e); and (g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from a primary myelofibrosis or is prone to suffering from primary myelofibrosis, said method comprising
    determining the presence of a gene product of one or more mutant alleles of the calreticulin gene in a sample from said patient; and
    assessing that said patient suffers from primary myelofibrosis or is prone to suffering from primary myelofibrosis when said gene product is present,
wherein said one or more mutant alleles comprises a nucleic acid encoding a mutant calreticulin protein as defined herein above,
wherein said gene product is selected from the group consisting of
(a) a protein encoded by a nucleic acid molecule having the nucleic acid sequence as depicted in SEQ ID NO: 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433;

(b) a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;

(c) a protein as defined in (a) or (b) wherein one or more amino acids are deleted, inserted, added or substituted;

(d) a protein encoded by a nucleic acid molecule encoding a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;

(e) a protein comprising an amino acid sequence encoded by a nucleic acid hybridizing under stringent conditions to the complementary strand of nucleic acid molecules as defined in (a) or (c);

(f) a protein having at least 70% identity to the protein of any one of (a) to (e); and (g) a protein comprising an amino acid sequence encoded by a nucleic acid being degenerate as a result of the genetic code to the nucleotide sequence of a nucleic acid as defined in (a), (d) or (e).

(f) a protein having at least 70% identity to the protein of any one of (a) to (e); and (g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from a primary myelofibrosis or is prone to suffering from primary myelofibrosis, said method comprising
    determining the presence of a gene product of one or more mutant alleles of the calreticulin gene in a sample from said patient; and
    assessing that said patient suffers from primary myelofibrosis or is prone to suffering from primary myelofibrosis when said gene product is present,
wherein said one or more mutant alleles comprises a nucleic acid encoding a mutant calreticulin protein as defined herein above,
wherein said gene product is selected from the group consisting of
(a) a protein encoded by a nucleic acid molecule having the nucleic acid sequence as depicted in SEQ ID NO: 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433; and (b) a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434.

The present invention relates to a method for assessing whether a patient suffers from essential thrombocythemia or is prone to suffering from essential thrombocythemia, said method comprising
    determining the presence of a gene product of one or more mutant alleles of the calreticulin gene in a sample from said patient; and
    assessing that said patient suffers from essential thrombocythemia or is prone to suffering from essential thrombocythemia when said gene product is present, wherein said one or more mutant alleles comprises a nucleic acid encoding a mutant calreticulin protein as defined herein above, wherein said gene product is selected from the group consisting of (a) a protein encoded by a nucleic acid molecule having the nucleic acid sequence as depicted in SEQ ID NO: 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433;

(b) a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;

(c) a protein as defined in (a) or (b) wherein one or more amino acids are deleted, inserted, added or substituted;

(d) a protein encoded by a nucleic acid molecule encoding a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;

(e) a protein comprising an amino acid sequence encoded by a nucleic acid hybridizing under stringent conditions to the complementary strand of nucleic acid molecules as defined in (a) or (c);

(f) a protein having at least 70% identity to the protein of any one of (a) to (e); and (g) a protein comprising an amino acid sequence encoded by a nucleic acid being degenerate as a result of the genetic code to the nucleotide sequence of a nucleic acid as defined in (a), (d) or (e).

(f) a protein having at least 70% identity to the protein of any one of (a) to (e); and (g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from essential thrombocythemia or is prone to suffering from essential thrombocythemia, said method comprising determining the presence of a gene product of one or more mutant alleles of the calreticulin gene in a sample from said patient; and assessing that said patient suffers from essential thrombocythemia or is prone to suffering from essential thrombocythemia when said gene product is present, wherein said one or more mutant alleles comprises a nucleic acid encoding a mutant calreticulin protein as defined herein above, wherein said gene product is selected from the group consisting of (a) a protein encoded by a nucleic acid molecule having the nucleic acid sequence as depicted in SEQ ID NO: 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433; and (b) a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434.

The present invention relates to a method for assessing whether a patient suffers from a refractory anemia with ringed sideroblasts and thrombocythemia (RARS-T) or is prone to suffering from refractory anemia with ringed sideroblasts and thrombocythemia (RARS-T), said method comprising determining the presence of a gene product of one or more mutant alleles of the calreticulin gene in a sample from said patient; and assessing that said patient suffers from refractory anemia with ringed sideroblasts and thrombocythemia (RARS-T) or is prone to suffering from refractory anemia with ringed sideroblasts and thrombocythemia (RARS-T) when said gene product is present, wherein said one or more mutant alleles comprises a nucleic acid encoding a mutant calreticulin protein as defined herein above, wherein said gene product is selected from the group consisting of (a) a protein encoded by a nucleic acid molecule having the nucleic acid sequence as depicted in SEQ ID NO: 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433;

(b) a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;

(c) a protein as defined in (a) or (b) wherein one or more amino acids are deleted, inserted, added or substituted;

(d) a protein encoded by a nucleic acid molecule encoding a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;

(e) a protein comprising an amino acid sequence encoded by a nucleic acid hybridizing under stringent conditions to the complementary strand of nucleic acid molecules as defined in (a) or (c);

(f) a protein having at least 70% identity to the protein of any one of (a) to (e); and (g) a protein comprising an amino acid sequence encoded by a nucleic acid being degenerate as a result of the genetic code to the nucleotide sequence of a nucleic acid as defined in (a), (d) or (e).

(f) a protein having at least 70% identity to the protein of any one of (a) to (e); and (g) a protein comprising an amino acid sequence encoded by a nucleic acid being degenerate as a result of the genetic code to the nucleotide sequence of a nucleic acid as defined in (a), (d) or (e).

The present invention relates to a method for assessing whether a patient suffers from a refractory anemia with ringed sideroblasts and thrombocythemia (RARS-T) or is prone to suffering from refractory anemia with ringed sideroblasts and thrombocythemia (RARS-T), said method comprising
  determining the presence of a gene product of one or more mutant alleles of the calreticulin gene in a sample from said patient; and
  assessing that said patient suffers from refractory anemia with ringed sideroblasts and thrombocythemia (RARS-T) or is prone to suffering from refractory anemia with ringed sideroblasts and thrombocythemia (RARS-T) when said gene product is present,
wherein said one or more mutant alleles comprises a nucleic acid encoding a mutant calreticulin protein as defined herein above,
wherein said gene product is selected from the group consisting of
(a) a protein encoded by a nucleic acid molecule having the nucleic acid sequence as depicted in SEQ ID NO: 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433; and
(b) a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434.

If the gene product is protein, the presence or amount of said protein can be determined routine techniques, such as by immunohistochemistry (IHC), by immunoassay, gel- or blot-based methods, IHC, mass spectrometry, flow cytometry, or FACS.

As the CALR mutations cause a frameshift of the translated polypeptide, a characteristic C-terminal amino acid sequence is present in the mutated calreticulin proteins as described and provided herein. This characteristic amino acid sequence alters the overall charge of the protein. It also alters the migration of the mutated calreticulin during protein electrophoresis. One can take advantage of this difference in charge and/or in migration behaviour in order to determine the presence of a mutated calreticulin protein. For example, antibodies specific to mutant calreticulin protein can be used to identify said mutant protein e.g. by Western immunoblotting. Optionally, also antibodies specific to the wild type calreticulin protein can be used (in addition) as a control. Such antibodies can include polyclonal and monoclonal antibodies which can be prepared by routine techniques.

Preferably, the patient is a human patient. The patient can be suspected of suffering from a myeloid malignancy or he/she can be suspected of being prone to suffering from a myeloid malignancy.

The following relates to samples to be used in accordance with the present invention. The sample can be a bone marrow sample, a blood sample or a saliva sample. The sample is preferably a blood sample. The blood sample preferably comprises peripheral granulocytes.

The sample can be obtained from a patient by routine techniques, for example, by biopsy.

The herein above provided method can further comprise administering an inhibitor of the mutant calreticulin as defined herein above to the patient.

The following relates to cDNA encoding the herein provided mutant calreticulin proteins.

The present invention relates to a nucleic acid selected from the group consisting of
(a) a nucleic acid encoding a polypeptide comprising an amino acid sequence as depicted in SEQ ID NO:4;
(b) a nucleic acid comprising a nucleotide sequence as depicted in SEQ ID NO: 2;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a nucleic acid selected from the group consisting of
(a) a nucleic acid encoding a polypeptide comprising an amino acid sequence as depicted in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(b) a nucleic acid comprising a nucleotide sequence as depicted in SEQ ID NO: 2, 6, 10, 14, 18, 22, 26, 30, 34, 38, 42, 46, 50, 54, 58, 62, 66, 70, 74, 78, 82, 86, 90, 94, 98, 102, 106, 110, 114, 118, 122, 126, 130, 134, 138, or 142;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a nucleic acid selected from the group consisting of
(a) a nucleic acid encoding a polypeptide comprising an amino acid sequence as depicted in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;
(b) a nucleic acid comprising a nucleotide sequence as depicted in SEQ ID NO: 146, 150, 154, 158, 162, 166, 170, 174, 178, 182, 186, 190, 194, 198, 202, 206, 210, 214, 218, 222, 226, 230, 234, 238, 242, 246, 250, 254, 258, 262, 266, 270, 274, 278, 282, or 286;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a nucleic acid is selected from the group consisting of
(a) a nucleic acid encoding a polypeptide comprising an amino acid sequence as depicted in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
(b) a nucleic acid comprising a nucleotide sequence as depicted in SEQ ID NO: 292, 296, 300, 304, 308, 312, 316, 320, 324, 328, 332, 336, 340, 344, 348, 352, 356, 360, 364, 368, 372, 376, 380, 384, 388, 392, 396, 400, 404, 408, 412, 416, 420, 424, 428, or 432;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

Preferably, the above defined nucleic acid is cDNA.

The following relates to mRNA encoding the herein provided mutant calreticulin proteins.

The present invention relates to a nucleic acid selected from the group consisting of
(a) a nucleic acid encoding a polypeptide comprising an amino acid sequence as depicted in SEQ ID NO:4;
(b) a nucleic acid comprising a nucleotide sequence as depicted in SEQ ID NO: 3;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a nucleic acid is selected from the group consisting of
(a) a nucleic acid encoding a polypeptide comprising an amino acid sequence as depicted in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(b) a nucleic acid comprising a nucleotide sequence as depicted in SEQ ID NO: 3, 7, 11, 15, 19, 23, 27, 31, 35, 39, 43, 47, 51, 55, 59, 63, 67, 71, 75, 79, 83, 87, 91, 95, 99, 103, 107, 111, 115, 119, 123, 127, 131, 135, 139, or 143;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a nucleic acid is selected from the group consisting of
(a) a nucleic acid encoding a polypeptide comprising an amino acid sequence as depicted in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;
(b) a nucleic acid comprising a nucleotide sequence as depicted in SEQ ID NO: 147, 151, 155, 159, 163, 167, 171, 175, 179, 183, 187, 191, 195, 199, 203, 207, 211, 215, 219, 223, 227, 231, 235, 239, 243, 247, 251, 255, 259, 263, 267, 271, 275, 279, 283, or 287;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a nucleic acid is selected from the group consisting of
(a) a nucleic acid encoding a polypeptide comprising an amino acid sequence as depicted in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
(b) a nucleic acid comprising a nucleotide sequence as depicted in SEQ ID NO: 293, 297, 301, 305, 309, 313, 317, 321, 325, 329, 333, 337, 341, 345, 349, 353, 357, 361, 365, 369, 373, 377, 381, 385, 389, 393, 397, 401, 405, 409, 413, 417, 421, 425, 429, or 433;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The above defined nucleic acid is preferably mRNA.

The following relates to genomic DNA encoding the herein provided mutant calreticulin proteins.

The present invention relates to a nucleic acid selected from the group consisting of
(a) a nucleic acid encoding a polypeptide comprising an amino acid sequence as depicted in SEQ ID NO: 4;
(b) a nucleic acid comprising a nucleotide sequence as depicted in SEQ ID NO: 1;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a nucleic acid selected from the group consisting of
(a) a nucleic acid encoding a polypeptide comprising an amino acid sequence as depicted in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(b) a nucleic acid comprising a nucleotide sequence as depicted in SEQ ID NO: 1, 5, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, or 141;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and (e) a nucleic acid comprising a nucleotide sequence which is degenerate as a result of the genetic code to the nucleotide sequence of a nucleic acid of any one of (a) to (d).

The present invention relates to a nucleic acid is selected from the group consisting of
(a) a nucleic acid encoding a polypeptide comprising an amino acid sequence as depicted in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;
(b) a nucleic acid comprising a nucleotide sequence as depicted in SEQ ID NO: 145, 149, 153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, or 285;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a nucleic acid is selected from the group consisting of
(a) a nucleic acid encoding a polypeptide comprising an amino acid sequence as depicted in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
(b) a nucleic acid comprising a nucleotide sequence as depicted in SEQ ID NO: 291, 295, 299, 303, 307, 311, 315, 319, 323, 327, 331, 335, 339, 343, 347, 351, 355, 359, 363, 367, 371, 375, 379, 383, 387, 391, 395, 399, 403, 407, 411, 415, 419, 423, 427, or 431;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The above defined nucleic acid is preferably genomic DNA.

The following relates to herein provided mutant calreticulin proteins.

The present invention relates to a protein selected from the group consisting of
(a) a protein encoded by a nucleic acid molecule having the nucleic acid sequence as depicted in SEQ ID NO: 1, 2 or 3;
(b) a protein comprising the amino acid sequence as shown in SEQ ID NO: 4;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 4;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a protein selected from the group consisting of
(a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, or 143;
(b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a protein selected from the group consisting of
(a) a protein encoded by a nucleic acid molecule having the nucleic acid sequence as depicted in SEQ ID NO: 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, or 287;
(b) a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, or 288;
(e) a protein comprising an amino acid sequence encoded by a nucleic acid hybridizing under stringent conditions to the complementary strand of nucleic acid molecules as defined in (a) or (c);

(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a protein selected from the group consisting of
(a) a protein encoded by a nucleic acid molecule having the nucleic acid sequence as depicted in SEQ ID NO: 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433;
(b) a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The meaning of the terms "polypeptide", "protein" and "nucleic acid sequence(s)/molecule(s)" are well known in the art and are used accordingly in context of the present invention. For example, "nucleic acid sequence(s)/molecule(s)" as used herein refer(s) to all forms of naturally occurring or recombinantly generated types of nucleic acids and/or nucleic acid sequences/molecules as well as to chemically synthesized nucleic acid sequences/molecules. This term also encompasses nucleic acid analogues and nucleic acid derivatives. The term "nucleic acid sequence(s)/molecule(s)" can refer to deoxyribonucleic acid (DNA) and ribonucleic acid (RNA). The "nucleic acid sequence(s)/molecule(s)" may be made by synthetic chemical methodology known to one of ordinary skill in the art, or by the use of recombinant technology, or may be isolated from natural sources, or by a combination thereof. The DNA and RNA may optionally comprise unnatural nucleotides and may be single or double stranded. "Nucleic acid sequence(s)/molecule(s)" also refers to sense and anti-sense DNA and RNA, that is, a nucleotide sequence which is complementary to a specific sequence of nucleotides in DNA and/or RNA. Furthermore, the term "nucleic acid sequence(s)/molecule(s)" may refer to DNA or RNA or hybrids thereof or any modification thereof that is known in the state of the art (see, e.g., U.S. Pat. No. 5,525,711, U.S. Pat. No. 4,711,955, U.S. Pat. No. 5,792,608 or EP 302175 for examples of modifications). The nucleic acid molecule(s) may be single- or double-stranded, linear or circular, natural or synthetic, and without any size limitation. For instance, the nucleic acid molecule(s) may be genomic DNA, cDNA, mRNA, antisense RNA, or a DNA encoding such RNAs or chimeroplasts (Colestrauss, Science (1996), 1386-1389). Said nucleic acid molecule(s) may be in the form of a plasmid or of viral DNA or RNA.

"Nucleic acid sequence(s)/molecule(s)" may also refer to (an) oligonucleotide(s), wherein any of the state of the art modifications such as phosphothioates or peptide nucleic acids (PNA) are included.

Nucleic acid sequence with a certain level of identity to the herein provided human sequences can be identified by the skilled person using methods known in the art, e.g. by using hybridization assays or by using alignments, either manually or by using computer programs such as those mentioned herein below in connection with the definition of the term "hybridization" and degrees of homology.

The nucleic acid sequence may be at least 70% identical to the nucleic acid sequence as shown in SEQ ID NO. 1. More preferably, the nucleic acid sequence is at least 90%, 91%, 92%, 93%, 94%, 95%, 96%, 97% or 98% identical to the nucleic acid sequence as shown in SEQ ID NO. 1, wherein the higher values are preferred. Most preferably, the nucleic acid sequence is at least 99% identical to the nucleic acid sequence as shown in SEQ ID NO. 1.

The nucleic acid sequence may be at least 70% identical to the nucleic acid sequence as shown in SEQ ID NO. 2. More preferably, the nucleic acid sequence is at least 90%, 91%, 92%, 93%, 94%, 95%, 96%, 97% or 98% identical to the nucleic acid sequence as shown in SEQ ID NO. 2, wherein the higher values are preferred. Most preferably, the nucleic acid sequence is at least 99% identical to the nucleic acid sequence as shown in SEQ ID NO. 2.

The nucleic acid sequence may be at least 70% identical to the nucleic acid sequence as shown in SEQ ID NO. 3. More preferably, the nucleic acid sequence is at least 90%, 91%, 92%, 93%, 94%, 95%, 96%, 97% or 98% identical to the nucleic acid sequence as shown in SEQ ID NO. 3, wherein the higher values are preferred. Most preferably, the nucleic acid sequence is at least 99% identical to the nucleic acid sequence as shown in SEQ ID NO. 3.

The nucleic acid sequence may be at least 70% identical to the nucleic acid sequence as shown in SEQ ID NO. 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, 143, 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, 287, 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433.

More preferably, the nucleic acid sequence is at least 90%, 91%, 92%, 93%, 94%, 95%, 96%, 97% or 98% identical to the nucleic acid sequence as shown in SEQ ID NOs. 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, 143, 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, 287, 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433, wherein the higher values are preferred.

Most preferably, the nucleic acid sequence is at least 99% identical to the nucleic acid sequence as shown in SEQ ID NO. 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, 143, 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, 287, 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433.

Hybridization assays for the characterization of nucleic acids with a certain level of identity to the nucleic acid sequences as provided herein are well known in the art; see e.g. Sambrook, Russell "Molecular Cloning, A Laboratory Manual", Cold Spring Harbor Laboratory, N.Y. (2001); Ausubel, "Current Protocols in Molecular Biology", Green Publishing Associates and Wiley Interscience, N.Y. (1989). The term "hybridization" or "hybridizes" as used herein may relate to hybridizations under stringent or non-stringent conditions. If not further specified, the conditions are preferably non-stringent. Said hybridization conditions may be established according to conventional protocols described, e.g., in Sambrook (2001) loc. cit.; Ausubel (1989) loc. cit., or Higgins and Hames (Eds.) "Nucleic acid hybridization, a practical approach" IRL Press Oxford, Washington D.C., (1985). The setting of conditions is well within the skill of the artisan and can be determined according to protocols described in the art. Thus, the detection of only specifically hybridizing sequences will usually require stringent hybridization and washing conditions such as, for example, the highly stringent hybridization conditions of 0.1×SSC, 0.1% SDS at 65° C. or 2×SSC, 60° C., 0.1% SDS. Low stringent hybridization conditions for the detection of homologous or not exactly complementary sequences may, for example, be set at 6×SSC, 1% SDS at 65° C. As is well known, the length of the probe and the composition of the nucleic acid to be determined constitute further parameters of the hybridization conditions.

It is envisaged herein that a nucleic acid can be a primer or probe, for example, a nucleic acid hybridizing under stringent conditions to the complementary strand of the nucleic acid of a mutant calreticulin (or of a fragment thereof as defined herein) or of the nucleic acid encoding a mutant calreticulin protein (or encoding the C-terminus thereof) or of exon 9 of the mutant calreticulin and the like as defined and provided herein above. Primers and probes are often in the range of 10-30 nucleotides. Thus, the invention relates to a nucleic acid hybridizing under stringent conditions to the complementary strand of the nucleic acid mutant calreticulin as defined and provided herein above, wherein said hybridizing nucleic acid is smaller than 50, 40 or 30 nucleotides and is larger than 5 or 10 nucleotides.

In accordance with the present invention, the terms "homology" or "percent homology" or "identical" or "percent identity" or "percentage identity" or "sequence identity" in the context of two or more nucleic acid sequences refers to two or more sequences or subsequences that are the same, or that have a specified percentage of nucleotides that are the same (at least 70%, 75%, 80%, 85%, most preferably at least 90%, 91%, 92%, 93%, 94%, 95%, 96%, 97% or 98% identity, most preferably at least 99% identity), when compared and aligned for maximum correspondence over a window of comparison (preferably over the full length), or over a designated region as measured using a sequence comparison algorithm as known in the art, or by manual alignment and visual inspection. Sequences having, for example, 75% to 90% or greater sequence identity may be considered to be substantially identical. Such a definition also applies to the complement of a test sequence. Preferably the described identity exists over a region that is at least about 15 to 25 nucleotides in length, more preferably, over a region that is at least about 50 to 100 nucleotides in length and most preferably over the full length.

Those having skill in the art will know how to determine percent identity between/among sequences using, for example, algorithms such as those based on CLUSTALW computer program (Thompson Nucl. Acids Res. 2 (1994), 4673-4680) or FASTDB (Brutlag Comp. App. Biosci. 6 (1990), 237-245), as known in the art.

Although the FASTDB algorithm typically does not consider internal non-matching deletions or additions in sequences, i.e., gaps, in its calculation, this can be corrected manually to avoid an overestimation of the % identity. CLUSTALW, however, does take sequence gaps into account in its identity calculations. Also available to those having skill in this art are the BLAST and BLAST 2.0 algorithms (Altschul, (1997) Nucl. Acids Res. 25:3389-3402; Altschul (1993) J. Mol. Evol. 36:290-300; Altschul (1990) J. Mol. Biol. 215: 403-410). The BLASTN program for nucleic acid sequences uses as defaults a word length (W) of 11, an expectation (E) of 10, M=5, N=4, and a comparison of both strands. The BLOSUM62 scoring matrix (Henikoff (1989) PNAS 89:10915) uses alignments (B) of 50, expectation (E) of 10, M=5, N=4, and a comparison of both strands.

In order to determine whether an nucleotide residue in a nucleic acid sequence corresponds to a certain position in the nucleotide sequence of e.g. SEQ ID NOs: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, 143, 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, 287, 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, and 433, respectively, the skilled person can use means and methods well-known in the art, e.g., alignments, either manually or by using computer programs such as those mentioned herein. For example, BLAST 2.0, which stands for Basic Local Alignment Search Tool BLAST (Altschul (1997), loc. cit.; Altschul (1993), loc. cit.; Altschul (1990), loc. cit.), can be used to search for local sequence alignments. BLAST, as discussed above, produces alignments of nucleotide sequences to determine sequence similarity. Because of the local nature of the alignments, BLAST is especially useful in determining exact matches or in identifying similar sequences. The fundamental unit of BLAST algorithm output is the High-scoring Segment Pair (HSP). An HSP consists of two sequence fragments of arbitrary but equal lengths whose alignment is locally maximal and for which the alignment score meets or exceeds a threshold or cut-off score set by the user. The BLAST approach is to look for HSPs between a query sequence and a database sequence, to evaluate the statistical significance of any matches found, and to report only those matches which satisfy the user-selected threshold of significance. The parameter E establishes the statistically significant threshold for reporting database sequence matches. E is interpreted as the upper bound of the expected frequency of chance occurrence of an HSP (or set of HSPs) within the context of the entire database search. Any database sequence whose match satisfies E is reported in the program output.

Analogous computer techniques using BLAST (Altschul (1997), loc. cit.; Altschul (1993), loc. cit.; Altschul (1990), loc. cit.) are used to search for identical or related molecules in nucleotide databases such as GenBank or EMBL. This analysis is much faster than multiple membrane-based hybridizations. In addition, the sensitivity of the computer search can be modified to determine whether any particular match is categorized as exact or similar. The basis of the search is the product score, which is defined as:

$$\frac{\% \text{ sequence identity} \times \% \text{ maximum } BLAST \text{ score}}{100}$$

and it takes into account both the degree of similarity between two sequences and the length of the sequence match. For example, with a product score of 40, the match will be exact within a 1-2% error; and at 70, the match will be exact. Similar molecules are usually identified by selecting those, which show product scores between 15 and 40, although lower scores may identify related molecules. Another example for a program capable of generating sequence alignments is the CLUSTALW computer program (Thompson (1994) Nucl. Acids Res. 2:4673-4680) or FASTDB (Brutlag (1990) Comp. App. Biosci. 6:237-245), as known in the art.

The explanations and definitions given herein above in respect of "homology/identity of nucleic acid sequences" apply, mutatis mutandis, to "amino acid sequences" of the herein provided mutant calreticulin proteins as depicted in SEQ ID NOs: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288, 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, and 434, respectively, as explained below.

The polypeptide to be used in accordance with the present invention may have at least 70% identity/similarity to the proteins having the amino acid sequence as, for example, depicted in SEQ ID NO: 4, respectively. More preferably, the polypeptide has at least 90%, 91%, 92%, 93%, 94%, 95%, 96%, 97% or 98% identity/similarity to the proteins depicted in SEQ ID NO: 4, respectively, wherein the higher values are preferred. Most preferably, the polypeptide has at least 99% homology to the protein as depicted in 4.

The polypeptide to be used in accordance with the present invention may have at least 70% identity/similarity to the proteins having the amino acid sequence as, for example, depicted in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288, 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, and 434, respectively. More preferably, the polypeptide has at least 90%, 91%, 92%, 93%, 94%, 95%, 96%, 97% or 98% identity/similarity to the proteins depicted in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288, 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, and 434, respectively, wherein the higher values are preferred. Most preferably, the polypeptide has at least 99% homology to the protein as depicted in 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288, 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, and 434, respectively.

Without deferring from the gist of the present invention also (a) (functional) fragment(s) or (a) (functional) derivative(s) of the herein provided polypeptides or proteins can be used, for example, (functional) fragment(s) or (functional) derivative(s) of the minimum C-terminus of the mutant calreticulin as shown in SEQ ID NO. 4. Also (a) (functional) fragment(s) or (a) (functional) derivative(s) of further herein provided mutant calreticulin polypeptides or proteins can be used, for example, (functional) fragment(s) or (functional) derivative(s) of the polypeptide(s) as shown in SEQ ID NOs: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288, 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, and 434, respectively.

Thus, a (functional) fragment of the above polypeptide(s)/protein(s) provided herein and to be used in accordance with the present invention can be any of the above specific polypeptides as shown in any one of SEQ ID NOs: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288, 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, and 434, respectively, wherein one or more amino acids are deleted.

A (functional) derivative(s) of the above polypeptide(s)/protein(s) provided herein and to be used in accordance with the present invention can be any of the above specific polypeptides as shown in SEQ ID NOs: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288, 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, and 434, respectively, wherein one or more amino acids are inserted, added or substituted.

Preferably, the deletion, insertion, addition and/or substitution of one or more amino acids is within the C-terminus of the herein provided mutant calreticulin, i.e. within the amino acid sequence of the polypeptide as shown in SEQ ID NOs: 4.

Preferably, the deletion, insertion, addition and/or substitution of one or more amino acids is within the C-terminus of the herein provided mutant calreticulin, i.e. within the amino acid sequence of the polypeptides as shown in SEQ ID NOs: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, respectively.

1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 amino acids can be deleted, inserted, added or substituted preferably within the C-terminus of the herein provided mutant calreticulin, i.e. within the amino acid sequence of the polypeptides as shown in SEQ ID NOs: 4.

1, 2, 3, 4, 5, 6, 7, 8, 9, 10, 11, 12, 13, 14, 5, 16, 17, 18, 19, 20, 21, 22, 23, 24, 25, 26, 27, 28, 29, 30, 31, 32, 33, 34, 35, 36, 37, 38, 39, or 40 amino acids can be deleted preferably from the C-terminus of the herein provided mutant calreticulin, i.e. from the amino acid sequence of the polypeptide as shown in SEQ ID NOs: 4.

1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 amino acids can be deleted, inserted, added and/or substituted preferably within the C-terminus of the herein provided mutant calreticulin, i.e. within the amino acid sequence of the polypeptides as shown in SEQ ID NOs: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, respectively.

The term "one or more amino acids deleted" relates to (functional) fragments of the specific mutant calreticulin proteins provided herein.

A preferred (functional) fragment of the above mentioned polypeptides provided herein and to be used in accordance with the present invention consists of from 15 to 25 contiguous amino acids. Accordingly, a (functional) fragment of the above mentioned polypeptides provided herein and to be used in accordance with the present invention preferably consists of 15, 16, 17, 18, 19, 20, 21, 22, 23, 24, or 25 contiguous amino acids.

A (functional) fragment of the above mentioned polypeptides provided herein and to be used in accordance with the present invention preferably consists of from 15 to 25 contiguous amino acids of the amino acid sequence shown in SEQ ID NO: 4.

A (functional) fragment of the above mentioned polypeptides provided herein and to be used in accordance with the present invention preferably consists of 15, 16, 17, 18, 19, 20, 21, 22, 23, 24, or 25 contiguous amino acids of the amino acid sequence shown in SEQ ID NO: 4.

A (functional) fragment of the above mentioned polypeptides provided herein and to be used in accordance with the present invention preferably consists of from 15 to 25 contiguous amino acids of the polypeptides as shown in SEQ ID NOs: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, respectively.

A (functional) fragment of the above mentioned polypeptides provided herein and to be used in accordance with the present invention preferably consists of 15, 16, 17, 18, 19, 20, 21, 22, 23, 24, or 25 contiguous amino acids of the polypeptides as shown in SEQ ID NOs: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, respectively.

A (functional) fragment of the above mentioned polypeptides provided herein and to be used in accordance with the present invention can consist of at least 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41 and up to 42 contiguous amino acids of the amino acid sequence shown in SEQ ID NO: 4.

A (functional) fragment of the above mentioned polypeptides provided herein and to be used in accordance with the present invention can consist of at least 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42 and up to 43 contiguous amino acids of the amino acid sequence shown in SEQ ID NO: 32 or 112.

A (functional) fragment of the above mentioned polypeptides provided herein and to be used in accordance with the present invention can consist of at least 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43 and up to 44 contiguous amino acids of the amino acid sequence shown in SEQ ID NO: 8, 128, 132 or 144.

A (functional) fragment of the above mentioned polypeptides provided herein and to be used in accordance with the present invention can consist of at least 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, and up to 45 contiguous amino acids of the amino acid sequence shown in SEQ ID NO: 12, 44, 136 or 140.

A (functional) fragment of the above mentioned polypeptides provided herein and to be used in accordance with the present invention can consist of at least 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45 and up to 46 contiguous amino acids of the amino acid sequence shown in SEQ ID NO: 16 or 124.

A (functional) fragment of the above mentioned polypeptides provided herein and to be used in accordance with the present invention can consist of at least 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, and up to 47 contiguous amino acids of the amino acid sequence shown in SEQ ID NO: 24, 40, 76, 100, or 120.

A (functional) fragment of the above mentioned polypeptides provided herein and to be used in accordance with the present invention can consist of at least 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, and up to 48 contiguous amino acids of the amino acid sequence shown in SEQ ID NO: 28, 36, 72, 84, 96 or 116.

A (functional) fragment of the above mentioned polypeptides provided herein and to be used in accordance with the present invention can consist of at least 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48 and up to 49 contiguous amino acids of the amino acid sequence shown in SEQ ID NO: 20, 48, 60, 64, 68, or 80.

A (functional) fragment of the above mentioned polypeptides provided herein and to be used in accordance with the present invention can consist of at least 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 and up to 50 contiguous amino acids of the amino acid sequence shown in SEQ ID NO: 52 or 56.

A (functional) fragment of the above mentioned polypeptides provided herein and to be used in accordance with the present invention can consist of at least 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51 and up to 52 contiguous amino acids of the amino acid sequence shown in SEQ ID NO: 92.

A (functional) fragment of the above mentioned polypeptides provided herein and to be used in accordance with the present invention can consist of at least 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52 and up to 53 contiguous amino acids of the amino acid sequence shown in SEQ ID NO: 88 or 104.

A (functional) fragment of the above mentioned polypeptides provided herein and to be used in accordance with the present invention can consist of at least 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53 and up to 54 contiguous amino acids of the amino acid sequence shown in SEQ ID NO: 108.

The fragment or derivative preferably has the same (or essentially the same) biological activity as the full length polypeptide from which it is derived, the full length polypeptide having the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288, 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, and 434. In this sense, the fragment or derivative is a "functional" fragment or derivative to be used herein.

The herein provided polypeptide (as shown, for example, in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288, 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, and 434, respectively) may have one or more amino acids deleted, inserted, added and/or substituted provided that the polypeptide maintains essentially the biological activity which is characteristic of the polypeptides from which it is derived.

Preferably, any such deletions, insertions, additions and/or substitutions (in this context particularly substitutions) are conservative, i.e. amino acids are substituted by amino acids having the same or similar characteristics. For example, a hydrophobic amino acid will preferably be substituted by another hydrophobic amino acid and so on.

The "biological activity" characteristic of the herein provided polypeptides can be considered as an activity which is causative for the (development) of a myeloid malignancy as defined herein, such as a myeloproliferative neoplasm (particularly primary myelofibrosis and essential thrombocytemia).

Inhibitors of Mutant Calreticulin

The present invention also provides for inhibitors of mutant calreticulin. These inhibitors can be used as a medicament.

The term "antagonist of mutant calreticulin" or "inhibitor of mutant calreticulin" means in context of the present invention a compound capable of fully or partially preventing or reducing the physiologic activity and/or expression level of (a) mutant calreticulin. The terms "antagonist" or "inhibitor" are used interchangeably herein.

In the context of the present invention said antagonist may, therefore, prevent, reduce, inhibit or inactivate the physiological activity of a mutant calreticulin upon binding of said compound/substance (i.e. antagonist/inhibitor) to said mutant calreticulin. As used herein, the term "antagonist" also encompasses competitive antagonists, (reversible) non-competitive antagonists or irreversible antagonist, as described, inter alia, in Mutschler, "Arzneimittelwirkungen" (1986), Wissenschaftliche Verlagsgesellschaft mbH, Stuttgart, Germany. Such an inhibition can be measured by determining substrate turnover.

An "antagonist" or "inhibitor" of a mutant calreticulin may also be capable of preventing the function of a mutant calreticulin by preventing/reducing the expression of the nucleic acid molecule encoding for said mutant calreticulin. Thus, an antagonist/inhibitor of a mutant calreticulin may lead to a decreased expression level of the mutant calreticulin (e.g. decreased level of an mutant calreticulin mRNA and/or of mutant calreticulin protein); this may be reflected in a decreased mutant calreticulin activity. The decreased activity and/or expression level can be measured/detected by known methods which are also described herein.

An "antagonist/inhibitor of a mutant calreticulin" may, for example, interfere with transcription of (an) mutant calreticulin gene(s), processing (e.g. splicing, export from the nucleus and the like) of the gene product(s) (e.g. unspliced or partially spliced mRNA) and/or translation of the gene product (e.g. mature mRNA). The "antagonist/inhibitor of a mutant calreticulin" may also interfere with further modification (like glycosylation or phosphorylation) of the polypeptide/protein encoded by the mutant calreticulin gene(s) and thus completely or partially inhibit the activity of the a mutant calreticulin protein(s) as described herein above. Furthermore, the "antagonist/inhibitor of a mutant calreticulin" may interfere with interactions of the mutant calreticulin protein(s) with other proteins (thus, for example, interfering with the activity of complexes involving mutant calreticulin protein(s)) or, in general, with its synthesis, e.g. by interfering with upstream steps of mutant calreticulin expression or with signalling pathways in which the mutant calreticulin is involved. Depending on the mode of action, such antagonists may, for example, be denoted "sequestering antagonists" or "signalling antagonists".

In sum, the herein described mutant calreticulin antagonist/inhibitor will, accordingly, lead to a decrease or reduction of mutant calreticulin expression level and/or activity, and thereby reduce its contribution to the development or proliferation of a myeloid malignancy as defined herein.

The antagonist(s) may be shRNA (small hairpin RNA), siRNA (small interfering RNA), miRNA (microRNA), dsRNA (double stranded RNA), stRNA (small temporal RNA), antisense molecules, extracellular binding-partners, small (binding) molecules, aptamers, intramers, or antibody molecules such as a full antibody (immunoglobulin), a F(ab)-fragment, a F(ab)-2-fragment, a single-chain antibody, a chimeric antibody, a CDR-grafted antibody, a bivalent antibody-construct, a synthetic antibody, a bispecific single chain antibody or a cross-cloned antibody.

The present invention relates to an siRNA or shRNA specifically targeting the nucleic acid encoding the mutant calreticulin protein(s), whereby the nucleic is especially mRNA as defined herein.

Up to 10% of the contiguous bases of the herein provided siRNAs or shRNAs can be non-complementary. The siRNA can further comprise at least one base at the 5' end and/or at least one base at the 3' end.

Antagonist(s)/inhibitor(s) which are nucleic acids, such as siRNAs, shRNAs, antisense molecules and the like can readily be prepared by known techniques using, for example, the following target sequences. For example, siRNAs, shRNAs and the like to be employed herein can comprise or consist of an RNA sequence corresponding to one of the target sequences below. The term "RNA sequence corresponding to" means in this context that the RNA sequence is identical to one of the target sequences below with the exception that the tymidine (T) residues of the target sequence is replaced by a uracil (U) residue. The siRNA can consist of a nucleic acid molecule comprising at least ten contiguous bases. For example, the siRNA, shRNA and the like can comprise at least ten contiguous bases of an RNA sequence corresponding to one of the target sequences below as defined above. The siRNA, shRNA and the like can consist of ten contiguous bases of an RNA sequence corresponding to one of the target sequences below as defined above.

The siRNA, shRNA and the like can target one of the target sequences below. These sequences relate to SEQ ID NO: 476 to SEQ ID NO: 1309, respectively, in order of appearance.

TABLE 2

| Type of CALR mutation | shRNA sequences covering the mutation site |
|---|---|
| Type 1 | AAGGACAAACAGGACGAGGAG |
| | AGGACAAACAGGACGAGGAGC |
| | GGACAAACAGGACGAGGAGCA |
| | GACAAACAGGACGAGGAGCAG |
| | ACAAACAGGACGAGGAGCAGG |
| | CAAACAGGACGAGGAGCAGAG |
| | AAACAGGACGAGGAGCAGAGG |
| | AACAGGACGAGGAGCAGAGGA |
| | ACAGGACGAGGAGCAGAGGAC |
| | CAGGACGAGGAGCAGAGGACA |
| | AGGACGAGGAGCAGAGGACAA |
| | GGACGAGGAGCAGAGGACAAG |
| | GACGAGGAGCAGAGGACAAGG |
| | ACGAGGAGCAGAGGACAAGGA |
| | CGAGGAGCAGAGGACAAGGAG |
| | GAGGAGCAGAGGACAAGGAGG |
| | AGGAGCAGAGGACAAGGAGGA |
| | GGAGCAGAGGACAAGGAGGAT |
| | GAGCAGAGGACAAGGAGGATG |
| | AGCAGAGGACAAGGAGGATGA |
| Type 2 | GAGGAGGAGGCAGAGGACAAT |
| | AGGAGGAGGCAGAGGACAATT |
| | GGAGGAGGCAGAGGACAATTG |
| | GAGGAGGCAGAGGACAATTGT |
| | AGGAGGCAGAGGACAATTGTC |
| | GGAGGCAGAGGACAATTGTCG |
| | GAGGCAGAGGACAATTGTCGG |
| | AGGCAGAGGACAATTGTCGGA |
| | GGCAGAGGACAATTGTCGGAG |
| | GCAGAGGACAATTGTCGGAGG |

TABLE 2-continued

| Type of CALR mutation | shRNA sequences covering the mutation site |
|---|---|
| | CAGAGGACAATTGTCGGAGGA |
| | AGAGGACAATTGTCGGAGGAT |
| | GAGGACAATTGTCGGAGGATG |
| | AGGACAATTGTCGGAGGATGA |
| | GGACAATTGTCGGAGGATGAT |
| | GACAATTGTCGGAGGATGATG |
| | ACAATTGTCGGAGGATGATGA |
| | CAATTGTCGGAGGATGATGAG |
| | AATTGTCGGAGGATGATGAGG |
| | ATTGTCGGAGGATGATGAGGA |
| | TTGTCGGAGGATGATGAGGAC |
| | TGTCGGAGGATGATGAGGACA |
| | GTCGGAGGATGATGAGGACAA |
| | TCGGAGGATGATGAGGACAAA |
| | CGGAGGATGATGAGGACAAAG |
| Type 3 | GACAAACAGGACGAGGAGCAG |
| | ACAAACAGGACGAGGAGCAGA |
| | CAAACAGGACGAGGAGCAGAG |
| | AAACAGGACGAGGAGCAGAGG |
| | AACAGGACGAGGAGCAGAGGC |
| | ACAGGACGAGGAGCAGAGGCA |
| | CAGGACGAGGAGCAGAGGCAG |
| | AGGACGAGGAGCAGAGGCAGA |
| | GGACGAGGAGCAGAGGCAGAG |
| | GACGAGGAGCAGAGGCAGAGG |
| | ACGAGGAGCAGAGGCAGAGGA |
| | CGAGGAGCAGAGGCAGAGGAC |
| | GAGGAGCAGAGGCAGAGGACA |
| | AGGAGCAGAGGCAGAGGACAA |
| | GGAGCAGAGGCAGAGGACAAG |
| | GAGCAGAGGCAGAGGACAAGG |
| | AGCAGAGGCAGAGGACAAGGA |
| | GCAGAGGCAGAGGACAAGGAG |
| | CAGAGGCAGAGGACAAGGAGG |
| | AGAGGCAGAGGACAAGGAGGA |
| Type 4 | AGGACGAGGAGCAGAGGCTTA |
| | GGACGAGGGGCAGAGGACAAG |
| | GACGAGGAGCAGAGGCTTAGG |
| | ACGAGGGGCAGAGGACAAGGA |
| | CGAGGAGCAGAGGCTTAGGAG |
| | GAGGAGCAGAGGCTTAGGAGG |
| | AGAGGCAGAGGACAAGGAGGA |
| | GGAGCAGAGGCTTAGGAGGAG |
| | GAGCAGAGGCTTAGGAGGAGG |
| | AGCAGAGGCTTAGGAGGAGGC |
| | GCAGAGGCTTAGGAGGAGGCA |
| | CAGAGGCTTAGGAGGAGGCAG |
| | AGAGGCTTAGGAGGAGGCAGA |
| | GAGGCTTAGGAGGAGGCAGAG |
| | AGGCTTAGGAGGAGGCAGAGG |
| | GGCTTAGGAGGAGGCAGAGGA |
| | GCTTAGGAGGAGGCAGAGGAC |
| | CTTAGGAGGAGGCAGAGGACA |
| | TTAGGAGGAGGCAGAGGACAA |
| | TAGGAGGAGGCAGAGGACAAG |
| Type 5 | GAAGGACAAACAGGACGAGGG |
| | AAGGACAAACAGGACGAGGGG |
| | AGGACAAACAGGACGAGGGGC |
| | GGACAAACAGGACGAGGGGCA |
| | GACAAACAGGACGAGGGGCAG |
| | ACAAACAGGACGAGGGGCAGA |
| | CAAACAGGACGAGGGGCAGAG |
| | AAACAGGACGAGGGGCAGAGG |
| | AACAGGACGAGGGGCAGAGGA |
| | ACAGGACGAGGGGCAGAGGAC |
| | CAGGACGAGGGGCAGAGGACA |
| | AGGACGAGGGGCAGAGGACAA |
| | GGACGAGGGGCAGAGGACAAG |
| | GACGAGGGGCAGAGGACAAGG |
| | ACGAGGGGCAGAGGACAAGGA |
| | CGAGGGGCAGAGGACAAGGAG |
| | GAGGGGCAGAGGACAAGGAGG |
| | AGGGGCAGAGGACAAGGAGGA |
| | GGGGCAGAGGACAAGGAGGAT |

| Type of CALR mutation | shRNA sequences covering the mutation site |
|---|---|
| | GGGCAGAGGACAAGGAGGATG |
| Type 6 | GGACAAACAGGACGAGGAGCG |
| | GACAAACAGGACGAGGAGCGG |
| | ACAAACAGGACGAGGAGCGGA |
| | CAAACAGGACGAGGAGCGGAG |
| | AAACAGGACGAGGAGCGGAGG |
| | AACAGGACGAGGAGCGGAGGC |
| | ACAGGACGAGGAGCGGAGGCA |
| | CAGGACGAGGAGCGGAGGCAG |
| | AGGACGAGGAGCGGAGGCAGA |
| | GGACGAGGAGCGGAGGCAGAG |
| | GACGAGGAGCGGAGGCAGAGG |
| | ACGAGGAGCGGAGGCAGAGGA |
| | CGAGGAGCGGAGGCAGAGGAC |
| | GAGGAGCGGAGGCAGAGGACA |
| | AGGAGCGGAGGCAGAGGACAA |
| | GGAGCGGAGGCAGAGGACAAG |
| | GAGCGGAGGCAGAGGACAAGG |
| | AGCGGAGGCAGAGGACAAGGA |
| | GCGGAGGCAGAGGACAAGGAG |
| | CGGAGGCAGAGGACAAGGAGG |
| Type 7 | AGGACGAGGAGCAGAGGCTTA |
| | GGACGAGGAGCGGAGGCAGAG |
| | GACGAGGAGCAGAGGCTTAGG |
| | ACGAGGAGCGGAGGCAGAGGA |
| | CGAGGAGCAGAGGCTTAGGAG |
| | GAGGGGCAGAGGACAAGGAGG |
| | AGGAGCAGAGGCTTAGGAGGA |
| | GGAGCAGAGGCTTAGGAGGAT |
| | GAGCAGAGGCTTAGGAGGATG |
| | AGCAGAGGCTTAGGAGGATGA |
| | GCAGAGGCTTAGGAGGATGAT |
| | CAGAGGCTTAGGAGGATGATG |
| | AGAGGCTTAGGAGGATGATGA |
| | GAGGCTTAGGAGGATGATGAG |
| | AGGCTTAGGAGGATGATGAGG |
| | GGCTTAGGAGGATGATGAGGA |
| | GCTTAGGAGGATGATGAGGAC |
| | CTTAGGAGGATGATGAGGACA |
| | TTAGGAGGATGATGAGGACAA |
| | TAGGAGGATGATGAGGACAAA |
| Type 8 | GACGAGGAGCAGAGGCTTAAG |
| | ACGAGGAGCAGAGGCTTAAGA |
| | CGAGGAGCAGAGGCTTAAGAG |
| | GAGGAGCAGAGGCTTAAGAGG |
| | AGGAGCAGAGGCTTAAGAGGA |
| | GGAGCAGAGGCTTAAGAGGAG |
| | GAGCAGAGGCTTAAGAGGAGG |
| | AGCAGAGGCTTAAGAGGAGGC |
| | GCAGAGGCTTAAGAGGAGGCA |
| | CAGAGGCTTAAGAGGAGGCAG |
| | AGAGGCTTAAGAGGAGGCAGA |
| | GAGGCTTAAGAGGAGGCAGAG |
| | AGGCTTAAGAGGAGGCAGAGG |
| | GGCTTAAGAGGAGGCAGAGGA |
| | GCTTAAGAGGAGGCAGAGGAC |
| | CTTAAGAGGAGGCAGAGGACA |
| | TTAAGAGGAGGCAGAGGACAA |
| | TAAGAGGAGGCAGAGGACAAG |
| | AAGAGGAGGCAGAGGACAAGG |
| | AGAGGAGGCAGAGGACAAGGA |
| Type 9 | AAGAAACGCAAAGAGGAGGAG |
| | AGAAACGCAAAGAGGAGGAGA |
| | GAAACGCAAAGAGGAGGAGAG |
| | AAACGCAAAGAGGAGGAGAGG |
| | AACGCAAAGAGGAGGAGAGGC |
| | ACGCAAAGAGGAGGAGAGGCA |
| | CGCAAAGAGGAGGAGAGGCAG |
| | GCAAAGAGGAGGAGAGGCAGA |
| | CAAAGAGGAGGAGAGGCAGAG |
| | AAAGAGGAGGAGAGGCAGAGG |
| | AAGAGGAGGAGAGGCAGAGGA |
| | AGAGGAGGAGAGGCAGAGGAC |

TABLE 2-continued

| Type of CALR mutation | shRNA sequences covering the mutation site |
|---|---|
| | GAGGAGGAGAGGCAGAGGACA |
| | AGGAGGAGAGGCAGAGGACAA |
| | GGAGGAGAGGCAGAGGACAAG |
| | GAGGAGAGGCAGAGGACAAGG |
| | AGGAGAGGCAGAGGACAAGGA |
| | GGAGAGGCAGAGGACAAGGAG |
| | GAGAGGCAGAGGACAAGGAGG |
| | AGAGGCAGAGGACAAGGAGGA |
| Type 10 | GGAGGAGGAGGCAGAGGACAT |
| | GAGGAGGAGGCAGAGGACATG |
| | AGGAGGAGGCAGAGGACATGT |
| | GGAGGAGGCAGAGGACATGTG |
| | GAGGAGGCAGAGGACATGTGT |
| | AGGAGGCAGAGGACATGTGTC |
| | GGAGGCAGAGGACATGTGTCG |
| | GAGGCAGAGGACATGTGTCGG |
| | AGGCAGAGGACATGTGTCGGA |
| | GGCAGAGGACATGTGTCGGAG |
| | GCAGAGGACATGTGTCGGAGG |
| | CAGAGGACATGTGTCGGAGGA |
| | AGAGGACATGTGTCGGAGGAT |
| | GAGGACATGTGTCGGAGGATG |
| | AGGACATGTGTCGGAGGATGA |
| | GGACATGTGTCGGAGGATGAT |
| | GACATGTGTCGGAGGATGATG |
| | ACATGTGTCGGAGGATGATGA |
| | CATGTGTCGGAGGATGATGAG |
| | ATGTGTCGGAGGATGATGAGG |
| | TGTGTCGGAGGATGATGAGGA |
| | GTGTCGGAGGATGATGAGGAC |
| | TGTCGGAGGATGATGAGGACA |
| | GTCGGAGGATGATGAGGACAA |
| | TCGGAGGATGATGAGGACAAA |
| | CGGAGGATGATGAGGACAAAG |
| Type 11 | AAGGACAAACAGGACGAGGAC |
| | AGGACAAACAGGACGAGGACC |
| | GGACAAACAGGACGAGGACCA |
| | GACAAACAGGACGAGGACCAG |
| | ACAAACAGGACGAGGACCAGA |
| | CAAACAGGACGAGGACCAGAG |
| | AAACAGGACGAGGACCAGAGG |
| | AACAGGACGAGGACCAGAGGC |
| | ACAGGACGAGGACCAGAGGCA |
| | CAGGACGAGGACCAGAGGCAG |
| | AGGACGAGGACCAGAGGCAGA |
| | GGACGAGGACCAGAGGCAGAG |
| | GACGAGGACCAGAGGCAGAGG |
| | ACGAGGACCAGAGGCAGAGGA |
| | CGAGGACCAGAGGCAGAGGAC |
| | GAGGACCAGAGGCAGAGGACA |
| | AGGACCAGAGGCAGAGGACAA |
| | GGACCAGAGGCAGAGGACAAG |
| | GACCAGAGGCAGAGGACAAGG |
| | ACCAGAGGCAGAGGACAAGGA |
| | CCAGAGGCAGAGGACAAGGAG |
| | CAGAGGCAGAGGACAAGGAGG |
| | AGAGGCAGAGGACAAGGAGGA |
| Type 12 | AAACAGGACGAGGAGCAGAGG |
| | AACAGGACGAGGAGCAGAGGA |
| | ACAGGACGAGGAGCAGAGGAG |
| | CAGGACGAGGAGCAGAGGAGG |
| | AGGACGAGGAGCAGAGGAGGA |
| | GGACGAGGAGCAGAGGAGGAG |
| | GACGAGGAGCAGAGGAGGAGG |
| | ACGAGGAGCAGAGGAGGAGGA |
| | CGAGGAGCAGAGGAGGAGGAG |
| | GAGGAGCAGAGGAGGAGGAGG |
| | AGGAGCAGAGGAGGAGGAGGA |
| | GGAGCAGAGGAGGAGGAGGAG |
| | GAGCAGAGGAGGAGGAGGAGG |
| | AGCAGAGGAGGAGGAGGAGGC |
| | GCAGAGGAGGAGGAGGAGGCA |
| | CAGAGGAGGAGGAGGAGGCAG |
| | AGAGGAGGAGGAGGAGGCAGA |

TABLE 2-continued

| Type of CALR mutation | shRNA sequences covering the mutation site |
|---|---|
| | GAGGAGGAGGAGGAGGCAGAG |
| | AGGAGGAGGAGGAGGCAGAGG |
| | GGAGGAGGAGGAGGCAGAGGA |
| Type 13 | ACAGGACGAGGAGCAGAGGCA |
| | CAGGACGAGGAGCAGAGGCAG |
| | AGGACGAGGAGCAGAGGCAGA |
| | GGACGAGGAGCAGAGGCAGAG |
| | GACGAGGAGCAGAGGCAGAGG |
| | ACGAGGAGCAGAGGCAGAGGA |
| | CGAGGAGCAGAGGCAGAGGAG |
| | GAGGAGCAGAGGCAGAGGAGG |
| | AGGAGCAGAGGCAGAGGAGGA |
| | GGAGCAGAGGCAGAGGAGGAG |
| | GAGCAGAGGCAGAGGAGGAGG |
| | AGCAGAGGCAGAGGAGGAGGC |
| | GCAGAGGCAGAGGAGGAGGCA |
| | CAGAGGCAGAGGAGGAGGCAG |
| | AGAGGCAGAGGAGGAGGCAGA |
| | GAGGCAGAGGAGGAGGCAGAG |
| | AGGCAGAGGAGGAGGCAGAGG |
| | GGCAGAGGAGGAGGCAGAGGA |
| | GCAGAGGAGGAGGCAGAGGAC |
| | CAGAGGAGGAGGCAGAGGACA |
| | AGAGGAGGAGGCAGAGGACAA |
| Type 14 | CAGGACGAGGAGCAGAGGCTG |
| | AGGACGAGGAGCAGAGGCTGA |
| | GGACGAGGAGCAGAGGCTGAG |
| | GACGAGGAGCAGAGGCTGAGG |
| | ACGAGGAGCAGAGGCTGAGGA |
| | CGAGGAGCAGAGGCTGAGGAG |
| | GAGGAGCAGAGGCTGAGGAGG |
| | AGGAGCAGAGGCTGAGGAGGA |
| | GGAGCAGAGGCTGAGGAGGAG |
| | GAGCAGAGGCTGAGGAGGAGG |
| | AGCAGAGGCTGAGGAGGAGGC |
| | GCAGAGGCTGAGGAGGAGGCA |
| | CAGAGGCTGAGGAGGAGGCAG |
| | AGAGGCTGAGGAGGAGGCAGA |
| | GAGGCTGAGGAGGAGGCAGAG |
| | AGGCTGAGGAGGAGGCAGAGG |
| | GGCTGAGGAGGAGGCAGAGGA |
| | GCAGAGGAGGAGGCAGAGGAC |
| | CTGAGGAGGAGGCAGAGGACA |
| | TGAGGAGGAGGCAGAGGACAA |
| Type 15 | AGGACGAGGAGCAGAGGCTTA |
| | GGACGAGGAGCAGAGGCTTAG |
| | GACGAGGAGCAGAGGCTTAGG |
| | ACGAGGAGCAGAGGCTTAGGA |
| | CGAGGAGCAGAGGCTTAGGAG |
| | GAGGAGCAGAGGCTTAGGAGG |
| | AGGAGCAGAGGCTTAGGAGGA |
| | GGAGCAGAGGCTTAGGAGGAG |
| | GAGCAGAGGCTTAGGAGGAGG |
| | AGCAGAGGCTTAGGAGGAGGG |
| | GCAGAGGCTTAGGAGGAGGGA |
| | CAGAGGCTTAGGAGGAGGGAG |
| | AGAGGCTTAGGAGGAGGGAGA |
| | GAGGCTTAGGAGGAGGGAGAG |
| | AGGCTTAGGAGGAGGGAGAGG |
| | GGCTTAGGAGGAGGGAGAGGA |
| | GCTTAGGAGGAGGGAGAGGAC |
| | CTTAGGAGGAGGGAGAGGACA |
| | TTAGGAGGAGGGAGAGGACAA |
| | TAGGAGGAGGGAGAGGACAAG |
| | AGGAGGAGGGAGAGGACAAGG |
| | GGAGGAGGGAGAGGACAAGGA |
| | GAGGAGGGAGAGGACAAGGAG |
| | AGGAGGGAGAGGACAAGGAGG |
| | GGAGGGAGAGGACAAGGAGGA |
| | GAGGGAGAGGACAAGGAGGAT |
| | AGGGAGAGGACAAGGAGGATG |
| | GGGAGAGGACAAGGAGGATGA |
| | GGAGAGGACAAGGAGGATGAT |
| | GAGAGGACAAGGAGGATGATG |

TABLE 2-continued

| Type of CALR mutation | shRNA sequences covering the mutation site |
|---|---|
| Type 16 | AGGACGAGGAGCAGAGGCTTC |
|  | GGACGAGGAGCAGAGGCTTCA |
|  | GACGAGGAGCAGAGGCTTCAG |
|  | ACGAGGAGCAGAGGCTTCAGA |
|  | CGAGGAGCAGAGGCTTCAGAG |
|  | GAGGAGCAGAGGCTTCAGAGG |
|  | AGGAGCAGAGGCTTCAGAGGA |
|  | GGAGCAGAGGCTTCAGAGGAG |
|  | GAGCAGAGGCTTCAGAGGAGG |
|  | AGCAGAGGCTTCAGAGGAGGC |
|  | GCAGAGGCTTCAGAGGAGGCA |
|  | CAGAGGCTTCAGAGGAGGCAG |
|  | AGAGGCTTCAGAGGAGGCAGA |
|  | GAGGCTTCAGAGGAGGCAGAG |
|  | AGGCTTCAGAGGAGGCAGAGG |
|  | GGCTTCAGAGGAGGCAGAGGA |
|  | GCTTCAGAGGAGGCAGAGGAC |
|  | CTTCAGAGGAGGCAGAGGACA |
|  | TTCAGAGGAGGCAGAGGACAA |
|  | TCAGAGGAGGCAGAGGACAAG |
|  | CAGAGGAGGCAGAGGACAAGG |
|  | AGAGGAGGCAGAGGACAAGGA |
| Type 17 | GACGAGGAGCAGAGGCTTAAG |
|  | ACGAGGAGCAGAGGCTTAAGA |
|  | CGAGGAGCAGAGGCTTAAGAG |
|  | GAGGAGCAGAGGCTTAAGAGG |
|  | AGGAGCAGAGGCTTAAGAGGA |
|  | GGAGCAGAGGCTTAAGAGGAG |
|  | GAGCAGAGGCTTAAGAGGAGG |
|  | AGCAGAGGCTTAAGAGGAGGC |
|  | GCAGAGGCTTAAGAGGAGGCA |
|  | CAGAGGCTTAAGAGGAGGCAG |
|  | AGAGGCTTAAGAGGAGGCAGT |
|  | GAGGCTTAAGAGGAGGCAGTG |
|  | AGGCTTAAGAGGAGGCAGTGG |
|  | GGCTTAAGAGGAGGCAGTGGA |
|  | GCTTAAGAGGAGGCAGTGGAC |
|  | CTTAAGAGGAGGCAGTGGACA |
|  | TTAAGAGGAGGCAGTGGACAA |
|  | TAAGAGGAGGCAGTGGACAAG |
|  | AAGAGGAGGCAGTGGACAAGG |
|  | AGAGGAGGCAGTGGACAAGGA |
|  | GAGGAGGCAGTGGACAAGGAG |
|  | AGGAGGCAGTGGACAAGGAGG |
|  | GGAGGCAGTGGACAAGGAGGA |
|  | GAGGCAGTGGACAAGGAGGAT |
|  | AGGCAGTGGACAAGGAGGATG |
|  | GGCAGTGGACAAGGAGGATGA |
|  | GCAGTGGACAAGGAGGATGAT |
|  | CAGTGGACAAGGAGGATGATG |
|  | AGTGGACAAGGAGGATGATGA |
|  | GTGGACAAGGAGGATGATGAG |
|  | TGGACAAGGAGGATGATGAGG |
| Type 18 | GACGAGGAGCAGAGGCTTAAG |
|  | ACGAGGAGCAGAGGCTTAAGA |
|  | CGAGGAGCAGAGGCTTAAGAG |
|  | GAGGAGCAGAGGCTTAAGAGG |
|  | AGGAGCAGAGGCTTAAGAGGA |
|  | GGAGCAGAGGCTTAAGAGGAT |
|  | GAGCAGAGGCTTAAGAGGATG |
|  | AGCAGAGGCTTAAGAGGATGA |
|  | GCAGAGGCTTAAGAGGATGAT |
|  | CAGAGGCTTAAGAGGATGATG |
|  | AGAGGCTTAAGAGGATGATGA |
|  | GAGGCTTAAGAGGATGATGAG |
|  | AGGCTTAAGAGGATGATGAGG |
|  | GGCTTAAGAGGATGATGAGGA |
|  | GCTTAAGAGGATGATGAGGAC |
|  | CTTAAGAGGATGATGAGGACA |
|  | TTAAGAGGATGATGAGGACAA |
|  | TAAGAGGATGATGAGGACAAA |
|  | AAGAGGATGATGAGGACAAAG |
|  | AGAGGATGATGAGGACAAAGA |

TABLE 2-continued

| Type of CALR mutation | shRNA sequences covering the mutation site |
|---|---|
| Type 19 | GAGCAGAGGCTTAAGGAGGAG |
|  | AGCAGAGGCTTAAGGAGGAGA |
|  | GCAGAGGCTTAAGGAGGAGAG |
|  | CAGAGGCTTAAGGAGGAGAGG |
|  | AGAGGCTTAAGGAGGAGAGGC |
|  | GAGGCTTAAGGAGGAGAGGCA |
|  | AGGCTTAAGGAGGAGAGGCAG |
|  | GGCTTAAGGAGGAGAGGCAGA |
|  | GCTTAAGGAGGAGAGGCAGAG |
|  | CTTAAGGAGGAGAGGCAGAGG |
|  | TTAAGGAGGAGAGGCAGAGGA |
|  | TAAGGAGGAGAGGCAGAGGAC |
|  | AAGGAGGAGAGGCAGAGGACA |
|  | AGGAGGAGAGGCAGAGGACAA |
|  | GGAGGAGAGGCAGAGGACAAG |
|  | GAGGAGAGGCAGAGGACAAGG |
|  | AGGAGAGGCAGAGGACAAGGA |
|  | GGAGAGGCAGAGGACAAGGAG |
|  | GAGAGGCAGAGGACAAGGAGG |
|  | AGAGGCAGAGGACAAGGAGGA |
| Type 20 | GCTTAAGGAGGAGGAAGAAGG |
|  | CTTAAGGAGGAGGAAGAAGGG |
|  | TTAAGGAGGAGGAAGAAGGGA |
|  | TAAGGAGGAGGAAGAAGGGAG |
|  | AAGGAGGAGGAAGAAGGGAGG |
|  | AGGAGGAGGAAGAAGGGAGGA |
|  | GGAGGAGGAAGAAGGGAGGAG |
|  | GAGGAGGAAGAAGGGAGGAGG |
|  | AGGAGGAAGAAGGGAGGAGGC |
|  | GGAGGAAGAAGGGAGGAGGCA |
|  | GAGGAAGAAGGGAGGAGGCAG |
|  | AGGAAGAAGGGAGGAGGCAGA |
|  | GGAAGAAGGGAGGAGGCAGAG |
|  | GAAGAAGGGAGGAGGCAGAGG |
|  | AAGAAGGGAGGAGGCAGAGGA |
|  | AGAAGGGAGGAGGCAGAGGAC |
|  | GAAGGGAGGAGGCAGAGGACA |
|  | AAGGGAGGAGGCAGAGGACAA |
|  | AGGGAGGAGGCAGAGGACAAG |
|  | GGGAGGAGGCAGAGGACAAGG |
| Type 21 | GCTTAAGGAGGAGGAAGAAGC |
|  | CTTAAGGAGGAGGAAGAAGCG |
|  | TTAAGGAGGAGGAAGAAGCGT |
|  | TAAGGAGGAGGAAGAAGCGTT |
|  | AAGGAGGAGGAAGAAGCGTTT |
|  | AGGAGGAGGAAGAAGCGTTTA |
|  | GGAGGAGGAAGAAGCGTTTAA |
|  | GAGGAGGAAGAAGCGTTTAAG |
|  | AGGAGGAAGAAGCGTTTAAGA |
|  | GGAGGAAGAAGCGTTTAAGAG |
|  | GAGGAAGAAGCGTTTAAGAGG |
|  | AGGAAGAAGCGTTTAAGAGGA |
|  | GGAAGAAGCGTTTAAGAGGAC |
|  | GAAGAAGCGTTTAAGAGGACA |
|  | AAGAAGCGTTTAAGAGGACAA |
|  | AGAAGCGTTTAAGAGGACAAG |
|  | GAAGCGTTTAAGAGGACAAGG |
|  | AAGCGTTTAAGAGGACAAGGA |
|  | AGCGTTTAAGAGGACAAGGAG |
|  | GCGTTTAAGAGGACAAGGAGG |
|  | CGTTTAAGAGGACAAGGAGGA |
|  | GTTTAAGAGGACAAGGAGGAT |
|  | TTTAAGAGGACAAGGAGGATG |
|  | TTAAGAGGACAAGGAGGATGA |
|  | TAAGAGGACAAGGAGGATGAT |
|  | AAGAGGACAAGGAGGATGATG |
| Type 22 | TTAAGGAGGAGGAAGAAGACA |
|  | TAAGGAGGAGGAAGAAGACAA |
|  | AAGGAGGAGGAAGAAGACAAC |
|  | AGGAGGAGGAAGAAGACAACG |
|  | GGAGGAGGAAGAAGACAACGC |
|  | GAGGAGGAAGAAGACAACGCA |
|  | AGGAGGAAGAAGACAACGCAA |
|  | GGAGGAAGAAGACAACGCAAA |

TABLE 2-continued

| Type of CALR mutation | shRNA sequences covering the mutation site |
|---|---|
| | GAGGAAGAAGACAACGCAAAG |
| | AGGAAGAAGACAACGCAAAGA |
| | GGAAGAAGACAACGCAAAGAG |
| | GAAGAAGACAACGCAAAGAGG |
| | AAGAAGACAACGCAAAGAGGA |
| | AGAAGACAACGCAAAGAGGAG |
| | GAAGACAACGCAAAGAGGAGG |
| | AAGACAACGCAAAGAGGAGGA |
| | AGACAACGCAAAGAGGAGGAG |
| | GACAACGCAAAGAGGAGGAGG |
| | ACAACGCAAAGAGGAGGAGGA |
| | CAACGCAAAGAGGAGGAGGAG |
| Type 23 | TTAAGGAGGAGGAAGAAGACT |
| | TAAGGAGGAGGAAGAAGACTG |
| | AAGGAGGAGGAAGAAGACTGC |
| | AGGAGGAGGAAGAAGACTGCG |
| | GGAGGAGGAAGAAGACTGCGT |
| | GAGGAGGAAGAAGACTGCGTG |
| | AGGAGGAAGAAGACTGCGTGA |
| | GGAGGAAGAAGACTGCGTGAG |
| | GAGGAAGAAGACTGCGTGAGG |
| | AGGAAGAAGACTGCGTGAGGA |
| | GGAAGAAGACTGCGTGAGGAG |
| | GAAGAAGACTGCGTGAGGAGG |
| | AAGAAGACTGCGTGAGGAGGA |
| | AGAAGACTGCGTGAGGAGGAG |
| | GAAGACTGCGTGAGGAGGAGG |
| | AAGACTGCGTGAGGAGGAGGA |
| | AGACTGCGTGAGGAGGAGGAG |
| | GACTGCGTGAGGAGGAGGAGG |
| | ACTGCGTGAGGAGGAGGAGGC |
| | CTGCGTGAGGAGGAGGAGGCA |
| | TGCGTGAGGAGGAGGAGGCAG |
| | GCGTGAGGAGGAGGAGGCAGA |
| | CGTGAGGAGGAGGAGGCAGAG |
| | GTGAGGAGGAGGAGGCAGAGG |
| | TGAGGAGGAGGAGGCAGAGGA |
| Type 24 | TTAAGGAGGAGGAAGAAGACA |
| | TAAGGAGGAGGAAGAAGACAG |
| | AAGGAGGAGGAAGAAGACAGG |
| | AGGAGGAGGAAGAAGACAGGA |
| | GGAGGAGGAAGAAGACAGGAG |
| | GAGGAGGAAGAAGACAGGAGG |
| | AGGAGGAAGAAGACAGGAGGC |
| | GGAGGAAGAAGACAGGAGGCA |
| | GAGGAAGAAGACAGGAGGCAG |
| | AGGAAGAAGACAGGAGGCAGA |
| | GGAAGAAGACAGGAGGCAGAG |
| | GAAGAAGACAGGAGGCAGAGG |
| | AAGAAGACAGGAGGCAGAGGA |
| | AGAAGACAGGAGGCAGAGGAC |
| | GAAGACAGGAGGCAGAGGACA |
| | AAGACAGGAGGCAGAGGACAA |
| | AGACAGGAGGCAGAGGACAAG |
| | GACAGGAGGCAGAGGACAAGG |
| | ACAGGAGGCAGAGGACAAGGA |
| | CAGGAGGCAGAGGACAAGGAG |
| Type 25 | AAGGAGGAGGAAGAAGACAAA |
| | AGGAGGAGGAAGAAGACAAAA |
| | GGAGGAGGAAGAAGACAAAAG |
| | GAGGAGGAAGAAGACAAAAGG |
| | AGGAGGAAGAAGACAAAAGGC |
| | GGAGGAAGAAGACAAAAGGCA |
| | GAGGAAGAAGACAAAAGGCAG |
| | AGGAAGAAGACAAAAGGCAGA |
| | GGAAGAAGACAAAAGGCAGAG |
| | GAAGAAGACAAAAGGCAGAGG |
| | AAGAAGACAAAAGGCAGAGGA |
| | AGAAGACAAAAGGCAGAGGAC |
| | GAAGACAAAAGGCAGAGGACA |
| | AAGACAAAAGGCAGAGGACAA |
| | AGACAAAAGGCAGAGGACAAG |
| | GACAAAAGGCAGAGGACAAGG |
| | ACAAAAGGCAGAGGACAAGGA |

TABLE 2-continued

| Type of CALR mutation | shRNA sequences covering the mutation site |
|---|---|
| | CAAAAGGCAGAGGACAAGGAG |
| | AAAAGGCAGAGGACAAGGAGG |
| | AAAGGCAGAGGACAAGGAGGA |
| | AAGGCAGAGGACAAGGAGGAT |
| Type 26 | AAGGAGGAGGAAGAAGACAAA |
| | AGGAGGAGGAAGAAGACAAAA |
| | GGAGGAGGAAGAAGACAAAAA |
| | GAGGAGGAAGAAGACAAAAAC |
| | AGGAGGAAGAAGACAAAAACG |
| | GGAGGAAGAAGACAAAAACGC |
| | GAGGAAGAAGACAAAAACGCA |
| | AGGAAGAAGACAAAAACGCAA |
| | GGAAGAAGACAAAAACGCAAA |
| | GAAGAAGACAAAAACGCAAAG |
| | AAGAAGACAAAAACGCAAAGA |
| | AGAAGACAAAAACGCAAAGAG |
| | GAAGACAAAAACGCAAAGAGG |
| | AAGACAAAAACGCAAAGAGGA |
| | AGACAAAAACGCAAAGAGGAG |
| | GACAAAAACGCAAAGAGGAGG |
| | ACAAAAACGCAAAGAGGAGGA |
| | CAAAAACGCAAAGAGGAGGAG |
| | AAAAACGCAAAGAGGAGGAGG |
| | AAAACGCAAAGAGGAGGAGGA |
| | AAACGCAAAGAGGAGGAGGAG |
| Type 27 | AGGAGGAGGAAGAAGACAAGT |
| | GGAGGAGGAAGAAGACAAGTG |
| | GAGGAGGAAGAAGACAAGTGT |
| | AGGAGGAAGAAGACAAGTGTT |
| | GGAGGAAGAAGACAAGTGTTT |
| | GAGGAAGAAGACAAGTGTTTC |
| | AGGAAGAAGACAAGTGTTTCG |
| | GGAAGAAGACAAGTGTTTCGC |
| | GAAGAAGACAAGTGTTTCGCA |
| | AAGAAGACAAGTGTTTCGCAA |
| | AGAAGACAAGTGTTTCGCAAA |
| | GAAGACAAGTGTTTCGCAAAG |
| | AAGACAAGTGTTTCGCAAAGA |
| | AGACAAGTGTTTCGCAAAGAG |
| | GACAAGTGTTTCGCAAAGAGG |
| | ACAAGTGTTTCGCAAAGAGGA |
| | CAAGTGTTTCGCAAAGAGGAG |
| | AAGTGTTTCGCAAAGAGGAGG |
| | AGTGTTTCGCAAAGAGGAGGA |
| | GTGTTTCGCAAAGAGGAGGAG |
| | TGTTTCGCAAAGAGGAGGAGG |
| | GTTTCGCAAAGAGGAGGAGGA |
| | TTTCGCAAAGAGGAGGAGGAG |
| | TTCGCAAAGAGGAGGAGGAGG |
| | TCGCAAAGAGGAGGAGGAGGC |
| Type 28 | GAAGAAGACAAGAAACGCAAA |
| | AAGAAGACAAGAAACGCAAAA |
| | AGAAGACAAGAAACGCAAAAG |
| | GAAGACAAGAAACGCAAAAGG |
| | AAGACAAGAAACGCAAAAGGA |
| | AGACAAGAAACGCAAAAGGAG |
| | GACAAGAAACGCAAAAGGAGG |
| | ACAAGAAACGCAAAAGGAGGA |
| | CAAGAAACGCAAAAGGAGGAT |
| | AAGAAACGCAAAAGGAGGATG |
| | AGAAACGCAAAAGGAGGATGA |
| | GAAACGCAAAAGGAGGATGAT |
| | AAACGCAAAAGGAGGATGATG |
| | AACGCAAAAGGAGGATGATGA |
| | ACGCAAAAGGAGGATGATGAG |
| | CGCAAAAGGAGGATGATGAGG |
| | GCAAAAGGAGGATGATGAGGA |
| | CAAAAGGAGGATGATGAGGAC |
| | AAAAGGAGGATGATGAGGACA |
| | AAAGGAGGATGATGAGGACAA |
| Type 29 | AAGACAAGAAACGCAAAGAGC |
| | AGACAAGAAACGCAAAGAGCC |
| | GACAAGAAACGCAAAGAGCCT |

TABLE 2-continued

| Type of CALR mutation | shRNA sequences covering the mutation site |
|---|---|
| | ACAAGAAACGCAAAGAGCCTC |
| | CAAGAAACGCAAAGAGCCTCC |
| | AAGAAACGCAAAGAGGACCAT |
| | AGAAACGCAAAGAGCCTCCTC |
| | GAAACGCAAAGAGCCTCCTCT |
| | AAACGCAAAGAGCCTCCTCTT |
| | AACGCAAAGAGCCTCCTCTTT |
| | ACGCAAAGAGCCTCCTCTTTG |
| | CGCAAAGAGCCTCCTCTTTGT |
| | GCAAAGAGCCTCCTCTTTGTC |
| | CAAAGAGCCTCCTCTTTGTCT |
| | AAAGAGCCTCCTCTTTGTCTA |
| | AAGAGCCTCCTCTTTGTCTAA |
| | AGAGCCTCCTCTTTGTCTAAG |
| | GAGCCTCCTCTTTGTCTAAGG |
| | AGCCTCCTCTTTGTCTAAGGA |
| | GCCTCCTCTTTGTCTAAGGAG |
| | CCTCCTCTTTGTCTAAGGAGG |
| | CTCCTCTTTGTCTAAGGAGGA |
| | TCCTCTTTGTCTAAGGAGGAT |
| | CCTCTTTGTCTAAGGAGGATG |
| | CTCTTTGTCTAAGGAGGATGA |
| | TCTTTGTCTAAGGAGGATGAT |
| | CTTTGTCTAAGGAGGATGATG |
| | TTTGTCTAAGGAGGATGATGA |
| | TTGTCTAAGGAGGATGATGAG |
| | TGTCTAAGGAGGATGATGAGG |
| | GTCTAAGGAGGATGATGAGGA |
| | TCTAAGGAGGATGATGAGGAC |
| | CTAAGGAGGATGATGAGGACA |
| | TAAGGAGGATGATGAGGACAA |
| Type 30 | GACAAGAAACGCAAAGAGGAC |
| | ACAAGAAACGCAAAGAGGACC |
| | CAAGAAACGCAAAGAGGACCA |
| | AAGAAACGCAAAGAGGACCAT |
| | AGAAACGCAAAGAGGACCATC |
| | GAAACGCAAAGAGGACCATCC |
| | AAACGCAAAGAGGACCATCCT |
| | AACGCAAAGAGGACCATCCTT |
| | ACGCAAAGAGGACCATCCTTG |
| | CGCAAAGAGGACCATCCTTGT |
| | GCAAAGAGGACCATCCTTGTC |
| | CAAAGAGGACCATCCTTGTCG |
| | AAAGAGGACCATCCTTGTCGG |
| | AAGAGGACCATCCTTGTCGGA |
| | AGAGGACCATCCTTGTCGGAG |
| | GAGGACCATCCTTGTCGGAGG |
| | AGGACCATCCTTGTCGGAGGA |
| | GGACCATCCTTGTCGGAGGAT |
| | GACCATCCTTGTCGGAGGATG |
| | ACCATCCTTGTCGGAGGATGA |
| | CCATCCTTGTCGGAGGATGAT |
| | CATCCTTGTCGGAGGATGATG |
| | ATCCTTGTCGGAGGATGATGA |
| | TCCTTGTCGGAGGATGATGAG |
| | CCTTGTCGGAGGATGATGAGG |
| | CTTGTCGGAGGATGATGAGGA |
| | TTGTCGGAGGATGATGAGGAC |
| | TGTCGGAGGATGATGAGGACA |
| | GTCGGAGGATGATGAGGACAA |
| | TCGGAGGATGATGAGGACAAA |
| | CGGAGGATGATGAGGACAAAG |
| Type 31 | AGAGGAGGAGGAGGCAGAGGG |
| | GAGGAGGAGGAGGCAGAGGGC |
| | AGGAGGAGGAGGCAGAGGGCA |
| | GGAGGAGGAGGCAGAGGGCAA |
| | GAGGAGGAGGCAGAGGGCAAT |
| | AGGAGGAGGCAGAGGGCAATT |
| | GGAGGAGGCAGAGGGCAATTG |
| | GAGGAGGCAGAGGGCAATTGT |
| | AGGAGGCAGAGGGCAATTGTC |
| | GGAGGCAGAGGGCAATTGTCG |
| | GAGGCAGAGGGCAATTGTCGG |
| | AGGCAGAGGGCAATTGTCGGA |
| | GGCAGAGGGCAATTGTCGGAG |

| Type of CALR mutation | shRNA sequences covering the mutation site |
|---|---|
| | GCAGAGGGCAATTGTCGGAGG |
| | CAGAGGGCAATTGTCGGAGGA |
| | AGAGGGCAATTGTCGGAGGAT |
| | GAGGGCAATTGTCGGAGGATG |
| | AGGGCAATTGTCGGAGGATGA |
| | GGGCAATTGTCGGAGGATGAT |
| | GGCAATTGTCGGAGGATGATG |
| | GCAATTGTCGGAGGATGATGA |
| | CAATTGTCGGAGGATGATGAG |
| | AATTGTCGGAGGATGATGAGG |
| | ATTGTCGGAGGATGATGAGGA |
| | TTGTCGGAGGATGATGAGGAC |
| | TGTCGGAGGATGATGAGGACA |
| | GTCGGAGGATGATGAGGACAA |
| | TCGGAGGATGATGAGGACAAA |
| | CGGAGGATGATGAGGACAAAG |
| Type 32 | AGGAGGAGGAGGCAGAGGACT |
| | GGAGGAGGAGGCAGAGGACTG |
| | GAGGAGGAGGCAGAGGACTGT |
| | AGGAGGAGGCAGAGGACTGTC |
| | GGAGGAGGCAGAGGACTGTCG |
| | GAGGAGGCAGAGGACTGTCGG |
| | AGGAGGCAGAGGACTGTCGGA |
| | GGAGGCAGAGGACTGTCGGAG |
| | GAGGCAGAGGACTGTCGGAGG |
| | AGGCAGAGGACTGTCGGAGGA |
| | GGCAGAGGACTGTCGGAGGAT |
| | GCAGAGGACTGTCGGAGGATG |
| | CAGAGGACTGTCGGAGGATGA |
| | AGAGGACTGTCGGAGGATGAT |
| | GAGGACTGTCGGAGGATGATG |
| | AGGACTGTCGGAGGATGATGA |
| | GGACTGTCGGAGGATGATGAG |
| | GACTGTCGGAGGATGATGAGG |
| | ACTGTCGGAGGATGATGAGGA |
| | CTGTCGGAGGATGATGAGGAC |
| | TGTCGGAGGATGATGAGGACA |
| | GTCGGAGGATGATGAGGACAA |
| | TCGGAGGATGATGAGGACAAA |
| | CGGAGGATGATGAGGACAAAG |
| Type 33 | GAGGAGGAGGCAGAGGACAAA |
| | AGGAGGAGGCAGAGGACAAAT |
| | GGAGGAGGCAGAGGACAAATG |
| | GAGGAGGCAGAGGACAAATGT |
| | AGGAGGCAGAGGACAAATGTC |
| | GGAGGCAGAGGACAAATGTCG |
| | GAGGCAGAGGACAAATGTCGG |
| | AGGCAGAGGACAAATGTCGGA |
| | GGCAGAGGACAAATGTCGGAG |
| | GCAGAGGACAAATGTCGGAGG |
| | CAGAGGACAAATGTCGGAGGA |
| | AGAGGACAAATGTCGGAGGAT |
| | GAGGACAAATGTCGGAGGATG |
| | AGGACAAATGTCGGAGGATGA |
| | GGACAAATGTCGGAGGATGAT |
| | GACAAATGTCGGAGGATGATG |
| | ACAAATGTCGGAGGATGATGA |
| | CAAATGTCGGAGGATGATGAG |
| | AAATGTCGGAGGATGATGAGG |
| | AATGTCGGAGGATGATGAGGA |
| | ATGTCGGAGGATGATGAGGAC |
| | TGTCGGAGGATGATGAGGACA |
| | GTCGGAGGATGATGAGGACAA |
| | TCGGAGGATGATGAGGACAAA |
| | CGGAGGATGATGAGGACAAAG |
| Type 34 | GGAGGAGGAGGCAGAGGACAC |
| | GAGGAGGAGGCAGAGGACACT |
| | AGGAGGAGGCAGAGGACACTT |
| | GGAGGAGGCAGAGGACACTTG |
| | GAGGAGGCAGAGGACACTTGT |
| | AGGAGGCAGAGGACACTTGTC |
| | GGAGGCAGAGGACACTTGTCG |
| | GAGGCAGAGGACACTTGTCGG |
| | AGGCAGAGGACACTTGTCGGA |

TABLE 2-continued

| Type of CALR mutation | shRNA sequences covering the mutation site |
|---|---|
| | GGCAGAGGACACTTGTCGGAG |
| | GCAGAGGACACTTGTCGGAGG |
| | CAGAGGACACTTGTCGGAGGA |
| | AGAGGACACTTGTCGGAGGAT |
| | GAGGACACTTGTCGGAGGATG |
| | AGGACAAATGTCGGAGGATGA |
| | GGACAAATGTCGGAGGATGAT |
| | GACACTTGTCGGAGGATGATG |
| | ACAAATGTCGGAGGATGATGA |
| | CACTTGTCGGAGGATGATGAG |
| | ACTTGTCGGAGGATGATGAGG |
| | CTTGTCGGAGGATGATGAGGA |
| | TTGTCGGAGGATGATGAGGAC |
| | TGTCGGAGGATGATGAGGACA |
| | GTCGGAGGATGATGAGGACAA |
| | TCGGAGGATGATGAGGACAAA |
| | CGGAGGATGATGAGGACAAAG |
| Type 35 | GGAGGAGGAGGCAGAGGACAT |
| | GAGGAGGAGGCAGAGGACATT |
| | AGGAGGAGGCAGAGGACATTT |
| | GGAGGAGGCAGAGGACATTTG |
| | GAGGAGGCAGAGGACAAGTGT |
| | AGGAGGCAGAGGACATTTGTC |
| | GGAGGCAGAGGACAAGTGTCG |
| | GAGGCAGAGGACATTTGTCGG |
| | AGGCAGAGGACATTTGTCGGA |
| | GGCAGAGGACAAGTGTCGGAG |
| | GCAGAGGACAAGTGTCGGAGG |
| | CAGAGGACATTTGTCGGAGGA |
| | AGAGGACATTTGTCGGAGGAT |
| | GAGGACATTTGTCGGAGGATG |
| | AGGACAAGTGTCGGAGGATGA |
| | GGACAAGTGTCGGAGGATGAT |
| | GACATTTGTCGGAGGATGATG |
| | ACAAGTGTCGGAGGATGATGA |
| | CATTTGTCGGAGGATGATGAG |
| | ATTTGTCGGAGGATGATGAGG |
| | TTTGTCGGAGGATGATGAGGA |
| | TTGTCGGAGGATGATGAGGAC |
| | TGTCGGAGGATGATGAGGACA |
| | GTCGGAGGATGATGAGGACAA |
| | TCGGAGGATGATGAGGACAAA |
| | CGGAGGATGATGAGGACAAAG |
| Type 36 | GGAGGAGGCAGAGGACAAGTG |
| | GAGGAGGCAGAGGACAAGTGT |
| | AGGAGGCAGAGGACAAGTGTC |
| | GGAGGCAGAGGACAAGTGTCG |
| | GAGGCAGAGGACAAGTGTCGG |
| | AGGCAGAGGACAAGTGTCGGA |
| | GGCAGAGGACAAGTGTCGGAG |
| | GCAGAGGACAAGTGTCGGAGG |
| | CAGAGGACAAGTGTCGGAGGA |
| | AGAGGACAAGTGTCGGAGGAT |
| | GAGGACAAGTGTCGGAGGATG |
| | AGGACAAGTGTCGGAGGATGA |
| | GGACAAGTGTCGGAGGATGAT |
| | GACAAGTGTCGGAGGATGATG |
| | ACAAGTGTCGGAGGATGATGA |
| | CAAGTGTCGGAGGATGATGAG |
| | AAGTGTCGGAGGATGATGAGG |
| | AGTGTCGGAGGATGATGAGGA |
| | GTGTCGGAGGATGATGAGGAC |
| | TGTCGGAGGATGATGAGGACA |
| | GTCGGAGGATGATGAGGACAA |
| | TCGGAGGATGATGAGGACAAA |
| | CGGAGGATGATGAGGACAAAG |

Antibodies

Herein contemplated are antibodies that specifically bind to the above provided mutant calreticulin protein(s). Such antibodies can be used for diagnostic and therapeutic purposes in accordance with the present invention. For example, antibodies raised against the C-terminal unique polypeptide of mutated calreticulin offers a diagnostic test for myeloid malignancy. Also detection of peptides derived from this unique C-terminus by mass spectrometry offers a diagnostic test for myeloid malignancy. Preferably, such antibodies are inhibitors of mutant calreticulin.

For example, antibodies to be used herein can specifically bind to the following mutant calreticulin protein(s) shown in SEQ ID NOs: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288, 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, and 434, respectively. Particularly, such antibodies can specifically bind to the C-terminus of the mutant calreticulin protein(s), for example, to proteins as shown in SEQ ID NOs: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, respectively.

It is invisaged herein that the antibodies can specifically bind to (functional) fragments or (functional) derivatives of the mutant calreticulin proteins as defined herein, for example also to polypeptides having at least 70% or more identity to herein provided mutant calreticulin protein(s).

Accordingly, the present invention relates to the use of these antibodies in the methods of the present invention. Therefore, the present invention relates to the use of the herein above described antibody/antibodies specifically binding to or specifically recognizing one or more of the herein described and provided mutant calreticulin proteins polypeptides for assessing whether a patient suffers from a myeloid malignancy or is prone to suffering from a myeloid malignancy.

The present invention also relates to an antibody/antibodies as defined above or the above composition comprising said antibody/antibodies for the preparation of a diagnostic kit for use in the methods of the present invention.

The antibody may be a polyclonal antibody, a monoclonal antibody, a full antibody (immunoglobulin), a F(ab)-fragment, a F(ab)$_2$-fragment, a single-chain antibody, a chimeric antibody, a CDR-grafted antibody, a bivalent antibody-construct, a bispecific single chain antibody, a synthetic antibody or a cross-cloned antibody and the like.

Polyclonal or monoclonal antibodies or other antibodies (derived therefrom) can be routinely prepared using, inter alia, standard immunization protocols; see Ed Harlow, David Lane, (December 1988), Antibodies: A Laboratory Manual, Cold Spring Harbor Laboratory; or Ed Harlow, David Lane, (December 1998), Portable Protocols (Using Antibodies): A Laboratory Manual 2$^{nd}$ edition, Cold Spring Harbor Laboratory.

For example, immunization may involve the intraperitoneal or subcutaneous administration of the mutant calreticulin protein/polypeptide (and/or fragments, isoforms, homologues and so on) as defined herein to a mammal (e.g. rodents such as mice, rats, hamsters and the like). Preferably, fragments of the mutant protein/polypeptide are used, wherein the fragment preferably bears the C-terminus (or a fragment thereof) as defined herein.

Methods for the preparation and screening of antibodies that specifically bind to or specifically recognize the mutant polypeptides are known in the art. For example, antibodies recognizing the mutant protein may be affinity purified. ELISA is commonly used for screening sera and/or assaying affinity column fractions. Western Blots can be used to demonstrate that the antibody can detect the actual protein of interest and to evaluate whether the antibody only recognizes the protein of interest, or if it cross-reacts with other proteins.

A person skilled in the art is in the position to apply and to adapt the teaching of these documents for the generation and validation of antibodies specifically binding to or specifically recognizing the polypeptides as defined herein in context of the present invention.

Mutant CALR as an Antigen

The following relates to the use of the herein provided mutant calreticulin proteins as a vaccine. Thus, the mutant calreticulin proteins act as antigens. Therefore, the terms "mutant calreticulin protein" and "mutant calreticulin protein antigens" and the like can be used interchangeably herein in the following.

In accordance with the above, the herein provided mutant calreticulin proteins can be used as a vaccine. In other words, herein provided mutant calreticulin proteins can be used in active immunization. Thus, the present invention relates to mutant calreticulin proteins as defined and provided herein (or nucleic acids (or vectors comprising same)) encoding mutant calreticulin proteins as defined and provided herein for use as vaccine. Mutant calreticulin proteins, fragments and derivatives thereof have been described herein above in great detail. These explanations and definitions apply, mutatis mutandis, in this context. Useful as vaccine are, in particular, proteins comprising or consisting of the C-terminus of the herein provided mutant calreticulin proteins as shown in SEQ ID NOs: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, respectively, as well as of fragments thereof. Particularly useful in this context are mutant calreticulin proteins that comprise or consist of the minimum C-terminus as shown in SEQ ID NO: 4 or a fragment thereof.

The present invention relates to a protein for use as vaccine, wherein the protein is selected from the group consisting of
(a) a protein encoded by a nucleic acid molecule having the nucleic acid sequence as depicted in SEQ ID NO: 1, 2 or 3;
(b) a protein comprising the amino acid sequence as shown in SEQ ID NO: 4;
(c) a protein as defined in (a) or (b) wherein one or more amino acids are deleted, inserted, added or substituted;
(d) a protein encoded by a nucleic acid molecule encoding a protein comprising the amino acid sequence as shown in SEQ ID NO: 4;
(e) a protein comprising an amino acid sequence encoded by a nucleic acid hybridizing under stringent conditions to the complementary strand of nucleic acid molecules as defined in (a) or (c);
(f) a protein having at least 70% identity to the protein of any one of (a) to (e); and
(g) a protein comprising an amino acid sequence encoded by a nucleic acid being degenerate as a result of the genetic code to the nucleotide sequence of a nucleic acid as defined in (a), (d) or (e).

The present invention relates to a protein for use as vaccine, wherein the protein is selected from the group consisting of
(a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, or 143;
(b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(c) a protein encoded by a nucleic acid molecule encoding a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;
(d) a protein comprising an amino acid sequence encoded by a nucleic acid hybridizing under stringent conditions to the complementary strand of nucleic acid molecules as defined in (a);
(e) a protein having at least 70% identity to the protein of any one of (a) to (d); and
(f) a protein comprising an amino acid sequence encoded by a nucleic acid being degenerate as a result of the genetic code to the nucleotide sequence of a nucleic acid as defined in (a), (c) or (d).

The present invention relates to a protein for use as vaccine as defined herein above, wherein the protein consists of 15 to 25 contiguous amino acids of the protein as shown in SEQ ID NO: 4.

Preferably, a fragment of the protein shown in SEQ ID NO: 4 comprising or consisting of 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 amino acids of the protein as shown in SEQ ID NO: 4 is used as vaccine. Particularly preferred are fragments of the protein shown in SEQ ID NO: 4 comprising or consisting of 15 to 25 contiguous amino acids of the protein as shown in SEQ ID NO: 4 for use as vaccine. Accordingly, a fragment of the protein shown in SEQ ID NO: 4 comprising or consisting of 15, 16, 17, 18, 19, 20, 21, 22, 23, 24, or 25 contiguous amino acids of the protein as shown in SEQ ID NO: 4 is used as vaccine.

Such fragments or derivatives of the protein shown in SEQ ID NO: 4 can be coupled to proteins such as keyholde lymphocyte hemocyanin (KLH), bovine serum albumin (BSA), bacterial toxoids (e.g. tetanus toxoid, diphtheria toxoid) and used for immunization.

The vaccine can be used in the treatment of myeloid malignancies as defined herein.

Accordingly, the present invention relates to a method for prophylactic or therapeutic treatment of a myeloid malignancy as defined herein, comprising administering an effective amount of the vaccine as defined herein above to a patient. In other words, the present invention relates to a method for prophylactic or therapeutic treatment of a myeloid malignancy as defined herein, comprising administering an effective amount of the mutant calreticulin protein as defined herein above to a patient.

For example, while a patient would not normally react to CALR, because of self-tolerance, many of the exon 9 mutations of CALR cause frameshifts such that the C-terminal portion of mutant CALR differs from the wild type and is therefore not subject to self-tolerance. Immunization with the mutant polypeptide would generate an immune response against mutant CALR. Accordingly, a vaccine can be used therapeutically to target the existing cancer.

A vaccine could also be used prophylactically. For example, it is known that cancers can mutate and evolve to evade the host immune response and anticancer treatment. Thus, a patient with a myeloid malignancy that has no CALR mutation, or a single CALR mutation, may later develop additional CALR mutations Immunization against other CALR mutant forms can, therefore, select against such CALR mutants.

CALR mutants can also be used to generate antibodies in vitro or in another animal for use in therapy in the patient. Such an approach is particularly useful because the antibodies can be produced against epitopes tolerated in the patient. Such antibodies are also useful for therapy because the titre can be precisely controlled, and the antibody may also be conjugated to toxins or radionuclides for targeted therapy.

An exemplary protocol for performing active immunization (or the use of the vaccines provided herein above) is described in the following:

For example, mice can be immunized with a vaccine (for example a peptide derived from the protein shown in SEQ ID NO: 4 or a peptide which is a fragment of the protein shown in SEQ ID NO: 4, wherein the peptide is coupled with KLH or BSA) before transplantation of bone marrow cells expressing mutant or wild type calreticulin. The immunized recipient mice can be sublethally or lethally irradiated to promote engraftment or not irradiated at all. The transplanted cells can be a mixture of cells expressing either mutated calreticulin or wild type calreticulin. The immunized mice will be followed after transplantation. If an immune response is elicited against mutant calreticulin expressing cells, the engraftment will be preferably occur with wild type calreticulin expressing cells. Control mice without immunisation will be used. Alternatively, immunization can be performed after engraftment of mice with a 50:50 (or other ratio) mixture of wild type/mutated calreticulin expression cells. If an immune response is elicited against mutant calreticulin expressing cells, the 50:50 (or other) ratio will change in favour of the wild type calreticulin expressing cells. Control mice without immunization will be used for comparison.

The present invention relates to the use of a mutant calreticulin protein as antigen as provided herein and defined herein above and, optionally, an adjuvant, for the manufacture of a vaccine composition for the treatment or prevention of myeloid malignancy as defined herein.

The mutant calreticulin protein can be produced recombinantly (i.e. produced in appropriate host cells) or synthetic (i.e. chemically synthesized). Recombinant production of mutant calreticulin protein is described herein. For example, recombinant production can be achieved using any one of the molecular cloning and recombinant expression techniques known in the art. For example, a nucleic acid molecule encoding mutant calreticulin protein can be introduced into an appropriate host cell, such as a bacterium, a yeast cell (e.g., a Pichia cell), an insect cell or a mammalian cell (e.g., CHO cell). The encoding nucleic acid molecule can be placed in an operable linkage to a promoter capable of effecting the expression of the mutant calreticulin protein antigen in the host cell. mutant calreticulin protein, which is expressed by the host cell, can be readily purified using routine protein purification techniques.

For example, the nucleotide sequence as set forth in SEQ ID NO: 1, 2 or 3 or a nucleic acid sequence encoding the mutant calreticulin protein antigen shown in SEQ ID NO: 4 or encoding fragment thereof, such as a protein consisting of 15 to 25 contiguous amino acids of the protein shown in SEQ ID NO: 4, can be cloned in an expression vector and placed in an operable linkage to a temperature sensitive promoter. The expression vector can be introduced into *Escherichia coli* and the antigen can be expressed upon heat induction. The cells can be lysed and the inclusion bodies where the antigen accumulates are separated by centrifugation. The recombinant protein in the inclusion bodies is solubilized using SDS or other solubilization agents known in the art such as urea, guanidine hydrochloride, sodium cholate, taurocholate, and sodium deoxycholate. In accordance with the present invention, a purified r recombinant mutant calreticulin protein is combined with a pharmaceutically acceptable carrier to form a vaccine composition.

The present invention provides an immunogenic composition for conferring protection in a patient against myeloid malignancy, the composition comprising a mutant calreticulin protein. The composition can be formulated as a vaccine for in vivo administration to a patient. The composition can comprise an adjuvant, such as aluminum hydroxide or aluminum phosphate.

Further, the present invention provides an immunogenic composition comprising a mutant calreticulin protein as defined herein above for use as a medicament. A composition comprising a mutant calreticulin protein as defined herein above can be used for the manufacture of a medicament for immunizing a host or patient against disease a myeloid malignancy.

The present invention is directed to a vaccine composition containing a mutant calreticulin protein antigen as defined herein (or "a mutant calreticulin protein vaccine"), that is suitable for administration to patients and is capable of protecting patients against a myeloid malignancy.

The term "a pharmaceutically acceptable carrier" includes any and all solvents, dispersion media, coatings, adjuvants, stabilizing agents, diluents, preservatives, antibacterial and antifungal agents, isotonic agents, adsorption delaying agents, and the like. Diluents can include water, saline, dextrose, ethanol, glycerol, and the like. Isotonic agents can include sodium chloride, dextrose, mannitol, sorbitol, and lactose, among others. Stabilizers include albumin, among others.

Adjuvants suitable for use in a vaccine composition in accordance with the present invention include, but are not limited to several adjuvant classes such as; mineral salts, e.g., Alum, aluminum hydroxide, aluminum phosphate and calcium phosphate; surface-active agents and microparticles, e.g., nonionic block polymer surfactants (e.g., cholesterol), virosomes, saponins (e.g., Quil A, QS-21 and GPI-0100), proteosomes, immune stimulating complexes, cochleates, quarterinary amines (dimethyl diocatadecyl ammonium bromide (DDA)), pyridine, vitamin A, vitamin E; bacterial products such as the RIBI adjuvant system (Ribi Inc.), cell wall skeleton of *Mycobacterum phlei* (Detox®), muramyl dipeptides (MDP) and tripeptides (MTP), monophosphoryl lipid A, *Bacillus* Calmete-Guerin, heat labile *E. coli* enterotoxins, cholera toxin, trehalose dimycolate, CpG oligodeoxnucleotides; cytokines and hormones, e.g., interleukins (IL-1, IL-2, IL-6, IL-12, IL-15, IL-18), granulocyte-macrophage colony stimulating factor, dehydroepiandrosterone, 1,25-dihydroxy vitamin D3; polyanions, e.g., dextran; polyacrylics (e.g., polymethylmethacrylate, Carbopol 934P); carriers e.g., tetanus toxid, diphtheria toxoid, cholera toxin B subunit, mutant heat labile enterotoxin of enterotoxigenic *E. coli* (rmLT), heat shock proteins; oilin-water emulsions e.g., AMPHIGEN® (Hydronics, USA); and water-in-oil emulsions such as, e.g., Freund's complete and incomplete adjuvants.

The herein provided mutant calreticulin protein antigen and the pharmaceutically acceptable carrier can be combined in any convenient and practical manner to form a vaccine composition, e.g., by admixture, solution, suspension, emulsification, encapsulation, absorption and the like, and can be made in formulations such as tablets, capsules, powder, syrup, suspensions that are suitable for injections, implantations, inhalations, ingestions or the like. Preferably, the vaccine is formulated such that it can be administered to patients by injection in a dose of about 0.1 to 5 ml, or preferably about 0.5 to 2.5 ml, or even more preferably, in a dose of about 1 ml.

When appropriate, the pharmaceutical compositions of the present invention should be made sterile by well-known procedures.

The amount of herein provided mutant calreticulin protein antigen in the vaccines should be immunizing-effective and is generally in the range of 0.5-1000 pg per dose.

The amount of adjuvants suitable for use in the vaccines depends upon the nature of the adjuvant used. For example, when Quil A and cholesterol are used as adjuvant, Quil A is generally in an amount of about 1-1000 Pg per dose; and cholesterol is generally in an amount of about 1-1000 Pg per dose.

In accordance with the present disclosure, a vaccine can be administered by any known routes, including the oral, intranasal, mucosal, topical, transdermal, and parenteral (e.g., intravenous, intraperitoneal, intradermal, subcutaneous or intramuscular). Administration can also be achieved using needle-free delivery devices. Administration can be achieved using a combination of routes, e.g., first administration using a parental route and subsequent administration using a mucosal route. Preferred routes of administration include subcutaneous and intramuscular administrations.

The present invention provides combination vaccines and methods for protecting patients by administering such combination vaccines.

The present invention provides an immunogenic agent, wherein the immunogenic agent is mutant calreticulin protein as defined and provided herein above. Said agent is effective to induce an immunogenic response against mutant calreticulin proteins in a patient. Therefore, the immunogenic agent can be used in the treatment or prevention of a myeloid malignancy as defined herein.

Further, the present invention provides a conjugate comprising an immunogenic agent linked to a carrier protein. The immunogenic agent is mutant calreticulin protein as defined and provided herein above. The carrier protein (such as serum albumin among others) can enhance the immune response. The conjugate can be a fusion protein comprising an immunogenic agent (i.e. the mutant calreticulin protein as defined and provided herein above) fused to a carrier protein. The agent can also be linked to the carrier protein by chemical cross-linking. The agent can be linked or fused to the amino terminus of the carrier protein. The agent can be linked or fused to the carboxyl of the carrier protein. The agent can be linked or fused internally to the carrier protein. Multiple repeats or multimers of the agent can be present in a conjugate, such as a fusion protein. The agent can be part of a longer polypeptide that includes the agent with other amino acids. The agent can be a component of a particle. The particle can be a liposome or a microparticle. The agent can be emulsified or encapsulated in the particle, such as a liposome or a microparticle.

The presence of a unique C-terminal polypeptide in mutated calreticulin proteins as provided herein offers the opportunity to target the mutant protein leaving the wild type protein intact. As the amino acid sequence derived from the −1 reading frame of calreticulin exon 9 encodes a peptide not showing homology to any other vertebrate protein, inhibitors as defined above (like antibodies (preferably inhibitory antibodies), siRNA, shRNAs or small molecule drugs) can be generated against it with a therapeutic effect. For example, the mutant calreticulin protein C-terminal amino acid sequence (such as the mutant protein derived from the alternative reading frame of exon 9) can be used for generation of polyclonal and monoclonal antibodies (preferably inhibitory antibodies). The mutant calreticulin as provided herein is therefore a valuable target for immunotherapy in myeloid malignancies. Alternatively, immunization of patients with the mutant peptide or recombinant mutant proteins can be used in therapeutic intervention of myeloid malignancy.

It has been shown that calreticulin is secreted from the cells and can be detected in serum. Calreticulin is also trafficked to the cellular surface where it provides an "eat me signal" for phagocytosis of apoptotic cells.

Accordingly, the present invention provides for an inhibitor of a mutant calreticulin for use as a medicament. Further, the present invention relates to the mutant calreticulin protein as provided herein, antibodies specifically binding thereto (preferably inhibitory antibodies), nucleic acids as provided herein (particularly nucleics acids encoding mutant calreticulin protein), the siRNA as provided herein for use as a medicament. The terms "medicament" and "pharmaceutical composition" are used interchangeably herein. Accordingly, definitions and explanations provided herein in relation to "pharmaceutical compositions", apply, mutatis mutandis, to the term "medicament".

Inhibitors of Mutant Calreticulin for Treatment of Myeloid Malignancy

The present invention relates to an inhibitor of a mutant calreticulin for use in the treatment of a myeloid malignancy.

The present invention provides a method for treating a myeloid malignancy patient comprising administering an effective amount of an inhibitor of a mutant calreticulin to the patient.

The patient to be treated can be a patient assessed "positive" in accordance with the present invention, i.e. a patient a sample of whom has been determined to have one or more mutant alleles of the calreticulin gene present.

Accordingly, the present invention relates to an inhibitor of a mutant calreticulin for use in the treatment of a myeloid malignancy, whereby a patient is to be treated, who suffers from a myeloid malignancy or is prone to suffering from a myeloid malignancy, whereby one or more mutant alleles of the calreticulin gene (or of a gene product thereof) in a sample from said patient is determined to be present.

All definitions and explanations given herein above in relation to the determination of the presence of one or more mutant alleles of the calreticulin gene (or of a gene product thereof) in a sample from said patient apply, mutatis mutandis, in this context.

The present invention provides a method for treating a myeloid malignancy patient comprising administering an effective amount of an inhibitor of a mutant calreticulin to the patient, the method further comprising assessing that the patient suffers from a myeloid malignancy or is prone to suffering from a myeloid malignancy, comprising determining the presence of one or more mutant alleles of the calreticulin gene (or of a gene product thereof) in a sample from said patient; and assessing that said patient suffers from a myeloid malignancy or is prone to suffering from a myeloid malignancy when said one or more mutant alleles of the calreticulin gene (or a gene product thereof) is present.

All definitions and explanations given herein above in relation to the determination of the presence of one or more mutant alleles of the calreticulin gene (or of a gene product thereof) in a sample from said patient apply, mutatis mutandis, in this context.

The mutant calreticulin can be a mutant calreticulin protein as defined herein above. If the mutant calreticulin is a mutant calreticulin protein, the inhibitor can be an antibody (preferably an inhibitory antibody), extracellular binding partners, small binding molecules, aptamers, or intramers.

The mutant calreticulin can be a nucleic acid encoding a mutant calreticulin protein as defined herein above. If the mutant calreticulin is such a nucleic acid (preferably mRNA as provided and defined above), the inhibitor can be siRNA, miRNA, dsRNA, shRNA, stRNA, and antisense molecules.

As mentioned above, myeloid malignancy includes a myeloproliferative neoplasm or a myelodysplastic syndrome. An exemplary myeloproliferative neoplasm is primary myelofibrosis (PMF). Preferred herein is the therapy of a myeloproliferative neoplasm, particularly that of primary myelofibrosis (PMF) or of essential thrombocythemia (ET). An exemplary myelodysplastic syndrome subject to therapeutic intervention in accordance with the present invention is refractory anemia with ringed sideroblasts and thrombocythemia (RARS-T).

The terms "treatment", "treating" and the like are used herein to generally mean obtaining a desired pharmacological and/or physiological effect. The effect may be prophylactic in terms of completely or partially preventing a disease or symptom thereof and/or may be therapeutic in terms of partially or completely curing a disease and/or adverse effect attributed to the disease. The term "treatment" as used herein covers any treatment of a disease in a subject and includes: (a) preventing a disease related in a subject which may be predisposed to the disease; (b) inhibiting the disease, i.e. arresting its development; or (c) relieving the disease, i.e. causing regression of the disease.

An "individual", "patient" or "subject" for the purposes of the present invention includes both humans and other animals, particularly mammals, and other organisms. Thus, the methods are applicable to both human therapy and veterinary applications. Preferably, the "individual", "patient" or "subject" is a mammal, and most preferably the "individual", "patient" or "subject" is human.

The inhibitor of a mutant calreticulin may be administered as a single agent (i.e. in form of a monotherapy) or in form of a combination therapy, for example, conventional therapies like hydroxyurea or interferon alpha therapy.

The pharmaceutical composition will be formulated and dosed in a fashion consistent with good medical practice, taking into account the clinical condition of the individual patient, the site of delivery of the pharmaceutical composition, the method of administration, the scheduling of administration, and other factors known to practitioners. The "effective amount" of the pharmaceutical composition for purposes herein is thus determined by such considerations.

The skilled person knows that the effective amount of pharmaceutical composition administered to an individual will, inter alia, depend on the nature of the compound.

For example, if said inhibitor is a small molecule, the total (pharmaceutically) effective amount of the inhibitor in the pharmaceutical composition administered orally per dose will be in the range of about 50 mg inhibitor per day to 1000 mg inhibitor per day of patient, although, as noted above, this will be subject to therapeutic discretion. More preferably, this dose is at least 50 mg inhibitor per day, and most preferably for humans between about 50 mg and 600 mg inhibitor per day. For example, an inhibitor may be administered at a dose of 15 mg/kg body weight per day. If given continuously, the inhibitor is typically administered at a dose rate of about 50 mg per day to about 600 mg per day. An intravenous bag solution may also be employed. The length of treatment needed to observe changes and the interval following treatment for responses to occur appears to vary depending on the desired effect. The particular amounts may be determined by conventional tests which are well known to the person skilled in the art. The length of treatment needed to observe changes and the interval following treatment for responses to occur appears to vary depending on the desired effect. The particular amounts may be determined by conventional tests which are well known to the person skilled in the art.

The administration of the herein provided compositions may, inter alia, comprise an administration twice daily, every day, every other day, every third day, every forth day, every fifth day, once a week, once every second week, once every third week, once every month, etc.

For example, if said compound is a (poly)peptide or protein the total pharmaceutically effective amount of pharmaceutical composition administered parenterally per dose will be in the range of about 1 µg protein/kg/day to 15 mg protein/kg/day of patient body weight, although, as noted above, this will be subject to therapeutic discretion. More preferably, this dose is at least 0.01 mg protein/kg/day, and most preferably for humans between about 0.01 and 1 mg protein/kg/day. If given continuously, the pharmaceutical composition is typically administered at a dose rate of about 1 µg/kg/hour to about 50 µg/kg/hour, either by 1-4 injections per day or by continuous subcutaneous infusions, for example, using a mini-pump. An intravenous bag solution may also be employed. The length of treatment needed to observe changes and the interval following treatment for responses to occur appears to vary depending on the desired effect. The particular amounts may be determined by conventional tests which are well known to the person skilled in the art.

Pharmaceutical compositions of the invention may be administered orally, rectally, parenterally, intracisternally, intravaginally, intraperitoneally, topically (as by powders, ointments, drops or transdermal patch), bucally, or as an oral or nasal spray.

Pharmaceutical compositions of the invention preferably comprise a pharmaceutically acceptable carrier. By "pharmaceutically acceptable carrier" is meant a non-toxic solid, semisolid or liquid filler, diluent, encapsulating material or formulation auxiliary of any type. The term "parenteral" as used herein refers to modes of administration which include intravenous, intramuscular, intraperitoneal, intrasternal, subcutaneous and intraarticular injection and infusion.

The pharmaceutical composition is also suitably administered by sustained release systems. Suitable examples of sustained-release compositions include semi-permeable polymer matrices in the form of shaped articles, e.g., films, or mirocapsules. Sustained-release matrices include polylactides (U.S. Pat. No. 3,773,919, EP 58,481), copolymers of L-glutamic acid and gamma-ethyl-L-glutamate (Sidman, U. et al., Biopolymers 22:547-556 (1983)), poly (2-hydroxyethyl methacrylate) (R. Langer et al., J. Biomed. Mater. Res. 15:167-277 (1981), and R. Langer, Chem. Tech. 12:98-105 (1982)), ethylene vinyl acetate (R. Langer et al., Id.) or poly-D-(−)-3-hydroxybutyric acid (EP 133,988). Sustained release pharmaceutical composition also include liposomally entrapped compound. Liposomes containing the pharmaceutical composition are prepared by methods known per se: DE 3,218,121; Epstein et al., Proc. Natl. Acad. Sci. (USA) 82:3688-3692 (1985); Hwang et al., Proc. Natl. Acad. Sci. (USA) 77:4030-4034 (1980); EP 52,322; EP 36,676; EP 88,046; EP 143,949; EP 142,641; Japanese Pat. Appl. 83-118008; U.S. Pat. Nos. 4,485,045 and 4,544,545; and EP 102,324. Ordinarily, the liposomes are of the small (about 200-800 Angstroms) unilamellar type in which the lipid content is greater than about 30 mol. percent cholesterol, the selected proportion being adjusted for the optimal therapy.

For parenteral administration, the pharmaceutical composition is formulated generally by mixing it at the desired degree of purity, in a unit dosage injectable form (solution, suspension, or emulsion), with a pharmaceutically acceptable carrier, i.e., one that is non-toxic to recipients at the dosages and concentrations employed and is compatible with other ingredients of the formulation.

Generally, the formulations are prepared by contacting the components of the pharmaceutical composition uniformly and intimately with liquid carriers or finely divided solid carriers or both. Then, if necessary, the product is shaped into the desired formulation. Preferably the carrier is a parenteral carrier, more preferably a solution that is isotonic with the blood of the recipient. Examples of such carrier vehicles include water, saline, Ringer's solution, and dextrose solution. Non aqueous vehicles such as fixed oils and ethyl oleate are also useful herein, as well as liposomes. The carrier suitably contains minor amounts of additives such as substances that enhance isotonicity and chemical stability. Such materials are non-toxic to recipients at the dosages and concentrations employed, and include buffers such as phosphate, citrate, succinate, acetic acid, and other organic acids or their salts; antioxidants such as ascorbic acid; low molecular weight (less than about ten residues) (poly)peptides, e.g., polyarginine or tripeptides; proteins, such as serum albumin, gelatin, or immunoglobulins; hydrophilic polymers such as polyvinylpyrrolidone; amino acids, such as glycine, glutamic acid, aspartic acid, or arginine; monosaccharides, disaccharides, and other carbohydrates including cellulose or its derivatives, glucose, manose, or dextrins; chelating agents such as EDTA; sugar alcohols such as mannitol or sorbitol; counterions such as sodium; and/or nonionic surfactants such as polysorbates, poloxamers, or PEG.

The components of the pharmaceutical composition to be used for therapeutic administration must be sterile. Sterility is readily accomplished by filtration through sterile filtration membranes (e.g., 0.2 micron membranes). Therapeutic components of the pharmaceutical composition generally are placed into a container having a sterile access port, for example, an intravenous solution bag or vial having a stopper pierceable by a hypodermic injection needle.

The components of the pharmaceutical composition ordinarily will be stored in unit or multi-dose containers, for example, sealed ampoules or vials, as an aqueous solution or as a lyophilized formulation for reconstitution. As an example of a lyophilized formulation, 10-ml vials are filled with 5 ml of sterile-filtered 1% (w/v) aqueous solution, and the resulting mixture is lyophilized. The infusion solution is prepared by reconstituting the lyophilized compound(s) using bacteriostatic Water-for-Injection.

Inhibitors for use in accordance with the present invention are described and provided herein. Also the use of inhibitors yet to be generated or known compounds to be tested for their inhibiting activity is envisaged in context of the present invention.

Therefore, the present invention provides a method for assessing the activity of a candidate molecule suspected of being an inhibitor of a mutant calreticulin as defined and provided herein comprising the steps of:
(a) contacting a cell, tissue or a non-human animal comprising a mutant calreticulin with said candidate molecule;
(b) detecting a decrease in activity of said mutant calreticulin; and
(c) selecting a candidate molecule that decreases activity of said mutant calreticulin;
wherein a decrease of the activity is indicative for the capacity of the selected molecule to be useful in the treatment of myeloid malignancy as defined herein.

Also a decrease in the (expression) level can indicate useful inhibitors.

The present invention relates to a method for assessing the activity of a candidate molecule suspected of being an inhibitor of a mutant calreticulin as defined and provided herein comprising the steps of:
(a) contacting a cell, tissue or a non-human animal comprising a mutant calreticulin with said candidate molecule;
(b) detecting a decrease in the (expression) level of said mutant calreticulin; and
(c) selecting a candidate molecule that decreases the (expression) level of said mutant calreticulin;
wherein a decrease of the (expression) level is indicative for the capacity of the selected molecule to be useful in the treatment of myeloid malignancy as defined herein.

The mutant calreticulin can be any of the mutant calreticulin proteins/polypeptides as defined herein above or any of the nucleic acids (particularly mRNAs) as defined herein, which encode the mutant calreticulin proteins/polypeptides.

The mutant calreticulin proteins can comprise or consist of the amino acid sequence of the polypeptides shown in 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288, 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, and 434, respectively. Also the use of fragments or derivatives of these proteins as defined above is envisaged in this context.

The mutant calreticulin nucleic acids can comprise or consist of the nucleic acids shown in 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, 143, 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, 287, 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, and 433, respectively.

Further, the present invention provides the use of (a) nucleic acid(s) (e.g. oligonucleotide(s) like primer(s)/primer pair(s) or probe(s) as described below) or antibody(ies) capable of detecting the presence of one or more mutant alleles of the calreticulin gene or the presence or amount of a gene product of one or more mutant alleles of the calreticulin gene as defined herein for the methods of the present invention, i.e. for assessing whether a patient suffers from a myeloid malignancy or is prone to suffering from a myeloid malignancy.

The oligonucleotide(s) may be about 15 to 100 nucleotides in length. Often primers and/or probes have a length of 10 to 30 nucleotides. A person skilled in the art is, based on his general knowledge and the teaching provided herein, easily in the position to identify and/or prepare (a) an oligo- or polynucleotide capable of detecting the presence of one or more mutant alleles of the calreticulin gene or the presence or amount of a gene product of one or more mutant alleles of the calreticulin gene as defined herein. These oligo- or polynucleotides may be used as probe(s) or primers in the methods provided herein. Accordingly, the invention relates to (a) nucleic acid(s) (in particular (a) primer(s) or (a) probe(s)) capable of detecting the presence of one or more mutant alleles of the calreticulin gene or the presence or amount of a gene product of one or more mutant alleles of the calreticulin gene as defined herein, wherein said nucleic acid is smaller than 50, 49, 48, 47, 46, 45, 44, 43, 42, 41, 40, 39, 38, 37, 36, 35, 34, 33, 32, 31, 30, 29, 28, 27, 26, 25, 24, 23, 22, 21, or 20 nucleotides and is larger than 5, 6, 7, 8, 9, 10, 11, 12, 13, 14, or 15 nucleotides. Preferably, the nucleic acid has a length of 10 to 35 nucleotides, more preferably 15 to 25 nucleotides, particularly preferred a length of 18 to 21, e.g. 18, 19, 20 or 21 nucleotides. These nucleic acid(s) may hybridize under stringent conditions to the complementary strand of the nucleic acid mutant calreticulin as defined and provided herein.

A skilled person will know, for example, computer programs which may be useful for the identification of corresponding probes/primers to be used herein. For example, the nucleic acid sequence(s) of exemplary coding sequences as disclosed herein (SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, 143, 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, 287, 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, and 433, respectively) may be used in this context.

Also the sequences disclosed in TABLE 1, above, may be used in this context:

Exemplary oligonucleotides (primers) provided herein and to be used in accordance with the present invention are

```
Forward:
ACAACTTCCTCATCACCAACG        (SEQ ID NO: 437)
and/or

Reverse:
GGCCTCAGTCCAGCCCTG           (SEQ ID NO: 438)

Forward:
GGCAAGGCCCTGAGGTGT           (SEQ ID NO: 439)
and/or

Reverse:
GGCCTCAGTCCAGCCCTG           (SEQ ID NO: 438)
```

Vectors, Transgenic Cells and Organisms Comprising Mutant CALR

In one embodiment, the present invention relates to transgenic cell or a transgenic non-human animal having the nucleic acid as described and explained herein (or a vector comprising same), e.g. a nucleic acid comprising at least one or more mutant alleles of the calreticulin gene as defined herein. Such transgenic cell(s) or a transgenic non-human animal(s) can be used for screening and/or validation of a medicament for the treatment of a myeloid malignancy.

The term "cell" as used in this context may also comprise a plurality of cells as well as cells comprised in a tissue. The cell to be used in the screening or validation method may be obtained from samples from a (transgenic) non-human animal or human suffering from a myeloid malignancy. The tumor cell or cell may also be obtained from patient samples (e.g. biopsies), in particular a biopsy/biopsies from a patient/subject suffering from a myeloid malignancy. Accordingly, the cell may be a human cell. Again, such a cell to be used in the present screening or validation methods may be comprised in a tissue or tissue sample, like in a sample biopsy.

The used non-human animal or cell may be transgenic or non transgenic. "Transgenic" in this context particularly means that at least one of the mutant calreticulins as described or defined herein is (over-) expressed and/or that the activity of at least one of the mutant calreticulins is present (or increased).

A preferred (transgenic) non-human animal or (transgenic) cell in context of the invention suffers from a myeloid malignancy.

The term "transgenic non-human animal" or "transgenic cell" as used herein refers to an non-human animal or cell, not being a human, that comprises genetic material different from the genetic material of a corresponding wild-type animal/cell. "Genetic material" in this context may be any kind of a nucleic acid molecule, or analogues thereof, for example a nucleic acid molecule, or analogues thereof as defined herein. "Different" in this context means additional or fewer genetic material with respect to the genome of the wild-type animal/cell and/or rearranged genetic material, i.e. genetic material present at a different locus of the genome with respect to the genome of the wild-type animal/cell. An overview of examples of different expression systems to be used for generating transgenic cell/animal is, for instance, contained in Methods in Enzymology 153 (1987), 385-516, in Bitter et al. (Methods in Enzymology 153 (1987), 516-544) and in Sawers et al. (Applied Microbiology and Biotechnology 46 (1996), 1-9), Billman-Jacobe (Current Opinion in Biotechnology 7 (1996), 500-4), Hockney (Trends in Biotechnology 12 (1994), 456-463), Griffiths et al., (Methods in Molecular Biology 75 (1997), 427-440).

In a preferred embodiment, the (transgenic) non-human animal or (transgenic) cell is or is derived from a mammal Non-limiting examples of the (transgenic) non-human animal or derived (transgenic) cell are selected from the group consisting of a mouse, a rat, a rabbit, and a guinea pig.

The present invention also relates to a vector comprising the nucleic acid molecule of the present invention.

Many suitable vectors are known to those skilled in molecular biology, the choice of which would depend on the function desired and include plasmids, cosmids, viruses, bacteriophages and other vectors used conventionally in genetic engineering. Methods which are well known to those skilled in the art can be used to construct various plasmids and vectors; see, for example, the techniques described in Sambrook et al. (loc cit.) and Ausubel, Current Protocols in Molecular Biology, Green Publishing Associates and Wiley Interscience, N.Y. (1989), (1994). Alternatively, the polynucleotides and vectors of the invention can be reconstituted into liposomes for delivery to target cells. As discussed in further details below, a cloning vector was used to isolate individual sequences of DNA. Relevant sequences can be transferred into expression vectors where expression of a particular polypeptide is required. Typical cloning vectors include pBluescript SK, pGEM, pUC9, pBR322 and pGBT9. Typical expression vectors include pTRE, pCAL-n-EK, pESP-1, pOP13CAT.

Preferably said vector comprises a nucleic acid sequence which is a regulatory sequence operably linked to said nucleic acid sequence defined herein.

The term "regulatory sequence" refers to DNA sequences, which are necessary to effect the expression of coding sequences to which they are ligated. The nature of such control sequences differs depending upon the host organism. In prokaryotes, control sequences generally include promoter, ribosomal binding site, and terminators. In eukaryotes generally control sequences include promoters, terminators and, in some instances, enhancers, transactivators or transcription factors. The term "control sequence" is intended to include, at a minimum, all components the presence of which are necessary for expression, and may also include additional advantageous components.

The term "operably linked" refers to a juxtaposition wherein the components so described are in a relationship permitting them to function in their intended manner. A control sequence "operably linked" to a coding sequence is ligated in such a way that expression of the coding sequence is achieved under conditions compatible with the control sequences. In case the control sequence is a promoter, it is obvious for a skilled person that double-stranded nucleic acid is preferably used.

Thus, the recited vector is preferably an expression vector. An "expression vector" is a construct that can be used to transform a selected host and provides for expression of a coding sequence in the selected host. Expression vectors can for instance be cloning vectors, binary vectors or integrating vectors. Expression comprises transcription of the nucleic acid molecule preferably into a translatable mRNA. Regulatory elements ensuring expression in prokaryotes and/or eukaryotic cells are well known to those skilled in the art. In the case of eukaryotic cells they comprise normally promoters ensuring initiation of transcription and optionally poly-A signals ensuring termination of transcription and stabilization of the transcript. Possible regulatory elements permitting expression in prokaryotic host cells comprise, e.g., the $P_L$, lac, trp or tac promoter in *E. coli*, and examples of regulatory elements permitting expression in eukaryotic host cells are the AOX1 or GAL1 promoter in yeast or the CMV-, SV40-, RSV-promoter (Rous sarcoma virus), CMV-enhancer, SV40-enhancer or a globin intron in mammalian and other animal cells.

Beside elements, which are responsible for the initiation of transcription such regulatory elements may also comprise transcription termination signals, such as the SV40-poly-A site or the tk-poly-A site, downstream of the polynucleotide. Furthermore, depending on the expression system used leader sequences capable of directing the polypeptide to a cellular compartment or secreting it into the medium may be added to the coding sequence of the recited nucleic acid sequence and are well known in the art; see also the appended Examples. The leader sequence(s) is (are) assembled in appropriate phase with translation, initiation and termination sequences, and preferably, a leader sequence capable of directing secretion of translated protein, or a portion thereof, into the periplasmic space or extracellular medium. Optionally, the heterologous sequence can encode a fusion protein including an N-terminal identification peptide imparting desired characteristics, e.g., stabilization or simplified purification of expressed recombinant product; see supra. In this context, suitable expression vectors are known in the art such as Okayama-Berg cDNA expression vector pcDV1 (Pharmacia), pCDM8, pRc/CMV, pcDNA1, pcDNA3 (In-vitrogene), pEF-DHFR, pEF-ADA or pEF-neo (Mack et al. PNAS (1995) 92, 7021-7025 and Raum et al. Cancer Immunol Immunother (2001) 50(3), 141-150) or pSPORT1 (GIBCO BRL).

Preferably, the expression control sequences will be eukaryotic promoter systems in vectors capable of transforming of transfecting eukaryotic host cells, but control sequences for prokaryotic hosts may also be used. Once the vector has been incorporated into the appropriate host, the host is maintained under conditions suitable for high level expression of the nucleotide sequences, and as desired, the collection and purification of the polypeptide of the invention may follow; see, e.g., the appended examples.

An alternative expression system, which can be used to express a cell cycle interacting protein is an insect system. In one such system, *Autographa californica* nuclear polyhedrosis virus (AcNPV) is used as a vector to express foreign genes in *Spodoptera frugiperda* cells or in *Trichoplusia larvae*. The coding sequence of a recited nucleic acid molecule may be cloned into a nonessential region of the virus, such as the polyhedrin gene, and placed under control of the polyhedrin promoter. Successful insertion of said coding sequence will render the polyhedrin gene inactive and produce recombinant virus lacking coat protein coat. The recombinant viruses are then used to infect *S. frugiperda* cells or *Trichoplusia larvae* in which the protein of the invention is expressed (Smith, J. Virol. 46 (1983), 584; Engelhard, Proc. Nat. Acad. Sci. USA 91 (1994), 3224-3227).

Additional regulatory elements may include transcriptional as well as translational enhancers. Advantageously, the above-described vectors of the invention comprise a selectable and/or scorable marker.

Selectable marker genes useful for the selection of transformed cells and, e.g., plant tissue and plants are well known to those skilled in the art and comprise, for example, antimetabolite resistance as the basis of selection for dhfr, which confers resistance to methotrexate (Reiss, Plant Physiol. (Life Sci. Adv.) 13 (1994), 143-149); npt, which confers resistance to the aminoglycosides neomycin, kanamycin and paromycin (Herrera-Estrella, EMBO J. 2 (1983), 987-995) and hygro, which confers resistance to hygromycin (Marsh, Gene 32 (1984), 481-485). Additional selectable genes have been described, namely trpB, which allows cells to utilize indole in place of tryptophan; hisD, which allows cells to utilize histinol in place of histidine (Hartman, Proc. Natl. Acad. Sci. USA 85 (1988), 8047); mannose-6-phosphate isomerase which allows cells to utilize mannose (WO 94/20627) and ODC (ornithine decarboxylase) which confers resistance to the ornithine decarboxylase inhibitor, 2-(difluoromethyl)-DL-ornithine, DFMO (McConlogue, 1987, In: Current Communications in Molecular Biology, Cold Spring Harbor Laboratory ed.) or deaminase from *Aspergillus terreus* which confers resistance to Blasticidin S (Tamura, Biosci. Biotechnol. Biochem. 59 (1995), 2336-2338).

Useful scorable markers are also known to those skilled in the art and are commercially available. Advantageously, said marker is a gene encoding luciferase (Giacomin, Pl. Sci. 116 (1996), 59-72; Scikantha, J. Bact. 178 (1996), 121), green fluorescent protein (Gerdes, FEBS Lett. 389 (1996), 44-47) or β-glucuronidase (Jefferson, EMBO J. 6 (1987), 3901-3907). This embodiment is particularly useful for simple and rapid screening of cells, tissues and organisms containing a recited vector.

As described above, the recited nucleic acid molecule can be used alone or as part of a vector to express the polypeptide of the invention in cells, for, e.g., purification but also for gene therapy purposes. The nucleic acid molecules or vectors containing the DNA sequence(s) encoding any one of the above described polypeptide of the invention is introduced into the cells which in turn produce the polypeptide of interest. Gene therapy, which is based on introducing therapeutic genes into cells by ex-vivo or in-vivo techniques is one of the most important applications of gene transfer. Suitable vectors, methods or gene-delivery systems for in-vitro or in-vivo gene therapy are described in the literature and are known to the person skilled in the art; see, e.g., Giordano, Nature Medicine 2 (1996), 534-539; Schaper, Circ. Res. 79 (1996), 911-919; Anderson, Science 256 (1992), 808-813; Verma, Nature 389 (1994), 239; Isner, Lancet 348 (1996), 370-374; Muhlhauser, Circ. Res. 77 (1995), 1077-1086; Onodera, Blood 91 (1998), 30-36; Verma, Gene Ther. 5 (1998), 692-699; Nabel, Ann. N.Y. Acad. Sci. 811 (1997), 289-292; Verzeletti, Hum. Gene Ther. 9 (1998), 2243-51; Wang, Nature Medicine 2 (1996), 714-716; WO 94/29469; WO 97/00957, U.S. Pat. No. 5,580,859; U.S. Pat. No. 5,589,466; or Schaper, Current Opinion in Biotechnology 7 (1996), 635-640. The recited nucleic acid molecules and vectors may be designed for direct introduction or for introduction via liposomes, or viral vectors (e.g., adenoviral, retroviral) into the cell. Preferably, said cell is a germ line cell, embryonic cell, or egg cell or derived there from, most preferably said cell is a stem cell. An example for an embryonic stem cell can be, inter alia, a stem cell as described in Nagy, Proc. Natl. Acad. Sci. USA 90 (1993), 8424-8428.

The invention also provides for a host transformed or transfected with a vector of the invention. Said host may be produced by introducing the above described vector of the invention or the above described nucleic acid molecule of the invention into the host. The presence of at least one vector or at least one nucleic acid molecule in the host may mediate the expression of a gene encoding the above described single chain antibody constructs.

The described nucleic acid molecule or vector of the invention, which is introduced in the host may either integrate into the genome of the host or it may be maintained extrachromosomally.

The host can be any prokaryote or eukaryotic cell.

The term "prokaryote" is meant to include all bacteria, which can be transformed or transfected with DNA or RNA molecules for the expression of a protein of the invention. Prokaryotic hosts may include gram negative as well as gram positive bacteria such as, for example, *E. coli, S. typhimurium, Serratia marcescens* and *Bacillus subtilis*. The term "eukaryotic" is meant to include yeast, higher plant, insect and preferably mammalian cells. Depending upon the host employed in a recombinant production procedure, the protein encoded by the polynucleotide of the present invention may be glycosylated or may be non-glycosylated. Especially preferred is the use of a plasmid or a virus containing the coding sequence of the polypeptide of the invention and genetically fused thereto an N-terminal FLAG-tag and/or C-terminal His-tag. Preferably, the length of said FLAG-tag is about 4 to 8 amino acids, most preferably 8 amino acids. An above described polynucleotide can be used to transform or transfect the host using any of the techniques commonly known to those of ordinary skill in the art. Furthermore, methods for preparing fused, operably linked genes and expressing them in, e.g., mammalian cells and bacteria are well-known in the art (Sambrook, loc cit.).

Preferably, said the host is a bacterium or an insect, fungal, plant or animal cell.

It is particularly envisaged that the recited host may be a mammalian cell. Particularly preferred host cells comprise CHO cells, COS cells, myeloma cell lines like SP2/0 or NS/0. As illustrated in the appended examples, particularly preferred are CHO-cells as hosts.

More preferably said host cell is a human cell or human cell line, e.g. per.c6 (Kroos, Biotechnol. Prog., 2003, 19:163-168).

In a further embodiment, the present invention thus relates to a process for the production of a polypeptide of the invention, said process comprising culturing a host of the invention under conditions allowing the expression of the polypeptide of the invention and recovering the produced polypeptide from the culture.

The transformed hosts can be grown in fermentors and cultured according to techniques known in the art to achieve optimal cell growth. The polypeptide of the invention can then be isolated from the growth medium, cellular lysates, or cellular membrane fractions. The isolation and purification of the, e.g., microbially expressed polypeptides of the invention may be by any conventional means such as, for example, preparative chromatographic separations and immunological separations such as those involving the use of monoclonal or polyclonal antibodies directed, e.g., against a tag of the polypeptide of the invention or as described in the appended examples.

The conditions for the culturing of a host, which allow the expression are known in the art to depend on the host system and the expression system/vector used in such process. The parameters to be modified in order to achieve conditions allowing the expression of a recombinant polypeptide are known in the art. Thus, suitable conditions can be determined by the person skilled in the art in the absence of further inventive input.

Once expressed, the polypeptide of the invention can be purified according to standard procedures of the art, including ammonium sulfate precipitation, affinity columns, column chromatography, gel electrophoresis and the like; see, Scopes, "Protein Purification", Springer-Verlag, N.Y. (1982). Substantially pure polypeptides of at least about 90 to 95% homogeneity are preferred, and 98 to 99% or more homogeneity are most preferred, for pharmaceutical uses. Once purified, partially or to homogeneity as desired, the polypeptide of the invention may then be used therapeutically (including extracorporeally) or in developing and performing assay procedures. Furthermore, examples for methods for the recovery of the polypeptide of the invention from a culture are described in detail in the appended examples.

Kits

Furthermore, the present invention provides a kit useful for carrying out the methods of the invention, the kit comprising a nucleic acid or an antibody capable of detecting the presence of a one or more mutant alleles of the calreticulin gene or the presence or amount of a gene product of one or more mutant alleles of the calreticulin gene as defined herein. Also envisaged herein is the use of the herein described kit for carrying out the herein provided methods.

For example, said kit may comprise (a) compound(s) required for specifically determining the presence of one or more mutant alleles of the calreticulin gene or the presence or amount of a gene product of one or more mutant alleles of the calreticulin gene as defined herein. Moreover, the present invention also relates to the use of (a) compound(s) required for specifically determining the presence of one or more mutant alleles of the calreticulin gene or the presence or amount of a gene product of one or more mutant alleles of the calreticulin gene as defined herein for the preparation of a kit for carrying out the methods of this invention. On the basis of the teaching of this invention, the skilled person knows which compound(s) is (are) required for specifically determining the presence of one or more mutant alleles of the calreticulin gene or the presence or amount of a gene product of one or more mutant alleles of the calreticulin gene as defined herein. For example, such compound(s) may be (a) "binding molecule(s)", like, for example, (a) antibody. Particularly, such compound(s) may be (a) (nucleotide) probe(s), (a) primer(s) (pair(s)), (an) antibody(ies) and/or (an) aptamer(s) specific for at least one mutant allele of the calreticulin gene or for a gene product of at least one mutant alleles of the calreticulin gene as defined herein. The kit (to be prepared in context) of this invention may be a diagnostic kit.

As mentioned herein, the determination of the presence of one (or more) mutant alleles of the calreticulin gene or of a gene product thereof as described herein can be performed as a stand-alone analysis. Alternatively, this analysis can be followed or preceded by the analysis of other markers for myeloid malignancies, such as JAK2 and MPL mutations. Also simultaneous determination of such markers is envisaged, like the simultaneous test for JAK2 mutation(s) and mutant calreticulin (and, optionally, further markers), or the simultaneous test of JAK2 mutation(s), mutant calreticulin and MPL mutation(s) (and, optionally, further markers). According (a) kit(s) (or uses of such kits) is/are envisaged herein that provide means for such subsequent or simultaneous tests. For example, said kit may comprise, in addition to (a) compound(s) required for specifically determining the presence (or amount) of one or more mutant alleles of the calreticulin gene (or of a gene product thereof), (a) compound(s) required for specifically determining the presence as JAK2 and/or MPL mutations (and optionally further markers), e.g. (a) antibody(ies), (a) (nucleotide) probe(s), (a) primer(s) (pair(s)), (an) antibody(ies) and/or (an) aptamer(s) specific that allow the specific detection of JAK2 and MPL mutations (and optionally further markers).

The kit (to be prepared in context) of this invention may further comprise or be provided with (an) instruction manual(s). For example, said instruction manual(s) may guide the skilled person (how) to determine the presence of one or more mutant alleles of the calreticulin gene or the presence or amount of a gene product of one or more mutant alleles of the calreticulin gene as defined herein and/or (how) to diagnose myeloid malignancy. Said instruction manual(s) may comprise guidance to use or apply the herein provided methods or uses. The kit (to be prepared in context) of this invention may further comprise substances/chemicals and/or equipment suitable/required for carrying out the methods and uses of this invention. For example, such substances/chemicals and/or equipment are solvents, diluents and/or buffers for stabilizing and/or storing (a) compound(s) required for specifically determining the presence of one or more mutant alleles of the calreticulin gene or the presence or amount of a gene product of one or more mutant alleles of the calreticulin gene as defined herein.

As used herein, the terms "comprising" and "including" or grammatical variants thereof are to be taken as specifying the stated features, integers, steps or components but do not preclude the addition of one or more additional features, integers, steps, components or groups thereof. This term encompasses the terms "consisting of" and "consisting essentially of"

Thus, the terms "comprising"/"including"/"having" mean that any further component (or likewise features, integers, steps and the like) can be present.

The term "consisting of" means that no further component (or likewise features, integers, steps and the like) can be present.

The term "consisting essentially of" or grammatical variants thereof when used herein are to be taken as specifying the stated features, integers, steps or components but do not preclude the addition of one or more additional features, integers, steps, components or groups thereof but only if the additional features, integers, steps, components or groups thereof do not materially alter the basic and novel characteristics of the claimed composition, device or method.

Thus, the term "consisting essentially of" means that specific further components (or likewise features, integers, steps and the like) can be present, namely those not materially affecting the essential characteristics of the composition, device or method. In other words, the term "consisting essentially of" (which can be interchangeably used herein with the term "comprising substantially"), allows the presence of other components in the composition, device or method in addition to the mandatory components (or likewise features, integers, steps and the like), provided that the essential characteristics of the device or method are not materially affected by the presence of other components.

The term "method" refers to manners, means, techniques and procedures for accomplishing a given task including, but not limited to, those manners, means, techniques and procedures either known to, or readily developed from known manners, means, techniques and procedures by practitioners of the chemical, biological and biophysical arts.

As used herein, the term "isolated" refers to a composition that has been removed from its in-vivo location. Preferably the isolated compositions or compounds of the present invention are substantially free from other substances (e.g., other proteins or other compounds) that are present in their in-vivo location (i.e. purified or semi-purified compositions or compounds.)

As used herein the term "about" refers to ±10%.

Treatment

Much treatment for myeloid malignancies is supportive—ameliorating the symptoms—but there is increased interest in curative therapies.

The purpose of treatment for polycythemia vera is to reduce the number of extra blood cells. Treatment of polycythemia vera may include, phlebotomy, chemotherapy with or without phlebotomy, biologic therapy using interferon alfa or pegylated interferon alpha and low-dose aspirin.

The treatment of primary myelofibrosis in patients without signs or symptoms is usually watchful waiting. Patients with primary myelofibrosis may have signs or symptoms of anemia. Anemia is usually treated with transfusion of red blood cells to relieve symptoms and improve quality of life. In addition, anemia may be treated with erythropoietic growth factors, prednisone, danazol, thalidomide, lenalidomide, or pomalidomide. Treatment of primary myelofibrosis in patients with other signs or symptoms may include targeted therapy with ruxolitinib (a JAK1 and JAK2 inhibitor), chemotherapy, donor stem cell transplant, thalidomide, lenalidomide, or pomalidomide, splenectomy, radiation therapy to the spleen, lymph nodes, or other areas outside the bone marrow where blood cells are forming, biologic therapy using interferon alfa or erythropoietic growth factors, or the inclusion in a clinical trial of other targeted therapy drugs.

Treatment of essential thrombocythemia in patients younger than 60 years who have no signs or symptoms and an acceptable platelet count is usually watchful waiting. In some cases, the patient can take aspirin to help prevent blood clots. Treatment of other patients may include Chemotherapy, hydroxyurea, Anagrelide therapy, biologic therapy using interferon alfa or pegylated interferon alpha, platelet apheresis.

The JAK-binding inhibitor ruxolitinib shows promise for curative and supportive treatment. Ruxolitinib has been approved by the Food and Drug Administration) for use in the treatment of high and intermediate risk myelofibrosis in 2011; see Tefferi Mar. 22, 2012; Blood: 119 (12) Also Ostojic reports that ruxolitinib is used in the therapy of myelofibrosis; see Ostojic Therapeutics and Clinical Risk Management 2012:8 95-103.

JAK inhibitors that are currently used in clinical trials for myeloproliferative neoplasms include, besides ruxolitinib, SAR302503, CYT387, lestaurtinib, SB1518, AZD1480, BMS911543, LY2784544, NS-018, and XL019; see Tefferi Mar. 22, 2012; Blood: 119 (12).

An exemplary formula of ruxolitinib ((3R)-3-cyclopentyl-3-[4-(7H-pyrrolo[2,3-d]pyrimidin-4-yl)pyrazol-1-yl]propanenitrile; trade name Jakafi, Jakavi) is shown below:

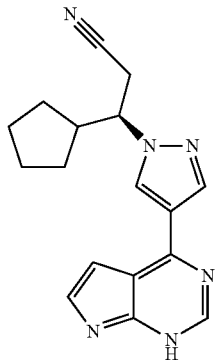 [SMILES: N#CC[C@H](C1CCCC1)n1cc(-c2nc[nH]c3nccc2-3)cn1]

Refractory anemia with ringed sideroblast and thrombocytosis may require blood transfusions and other supportive therapy to remedy anemia, including high doses of pyridoxine (Vitamin B6). Bone marrow transplant is also an option. RARS-T may also progress to leukemia.

The use of above therapies is contemplated for patients diagnosed positive for the presence of mutant calreticulin in accordance with the present invention, either alone or in combination with therapies (e.g. antibodies) specifically targeting the mutant calreticulin. Accordingly, therapies (e.g. antibodies) that target mutant CALR, can likewise be useful in treatment if used as monotherapy or in combination with other therapies.

If, for example, the patient is tested positive for the presence of mutant calreticulin and (a) JAK2 mutation(s), the use of JAK inhibitor(s) (like ruxolitinib) is contemplated herein. Depending on clinical parameters, (e.g age, prognosis of the patient) also further therapies, like stem cell transplantation can be used to treat e.g. a patient tested positive for the presence of mutant calreticulin.

Embodiments of the Invention

The present invention relates to the following items:
1. A method for assessing whether a patient suffers from a myeloid malignancy or is prone to suffering from a myeloid malignancy, said method comprising
   determining the presence of one or more mutant alleles of the calreticulin gene in a sample from said patient; and
   assessing that said patient suffers from a myeloid malignancy or is prone to suffering from a myeloid malignancy when said one or more mutant alleles of the calreticulin gene is present.
2. The method according to item 1, wherein said myeloid malignancy is selected from the group consisting of primary myelofibrosis (PMF), essential thrombocythemia (ET) and refractory anemia with ringed sideroblasts and thrombocythemia (RARS-T).
3. The method according to item 1 or 2,
   wherein said one or more mutant alleles comprises a nucleic acid encoding a mutant calreticulin protein, wherein said mutant calreticulin protein is selected from the group consisting of
   (a) a protein encoded by a nucleic acid molecule having the nucleic acid sequence as depicted in SEQ ID NO: 1, 2 or 3;
   (b) a protein comprising the amino acid sequence as shown in SEQ ID NO: 4;
   (c) a protein encoded by a nucleic acid molecule encoding a protein comprising the amino acid sequence as shown in SEQ ID NO: 4;
   (d) a protein comprising an amino acid sequence encoded by a nucleic acid hybridizing under stringent conditions to the complementary strand of nucleic acid molecules as defined in (a);
   (e) a protein having at least 70% identity to the protein of any one of (a) to (d); and
   (f) a protein comprising an amino acid sequence encoded by a nucleic acid being degenerate as a result of the genetic code to the nucleotide sequence of a nucleic acid as defined in (a), (c) or (d).
4. The method according to item 3, wherein said mutant calreticulin protein is selected from the group consisting of
   (a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, 143, 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, 287, 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, 433;

(b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288, 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, 434;

(c) a protein encoded by a nucleic acid molecule encoding a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288, 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, 434;

(d) a protein comprising an amino acid sequence encoded by a nucleic acid hybridizing under stringent conditions to the complementary strand of nucleic acid molecules as defined in (a);

(e) a protein having at least 70% identity to the protein of any one of (a) to (d); and (f) a protein comprising an amino acid sequence encoded by a nucleic acid being degenerate as a result of the genetic code to the nucleotide sequence of a nucleic acid as defined in (a), (c) or (d).

5. The method according to any one of items 1 to 4, wherein said mutant allele has a frameshift mutation in exon 9 of the calreticulin gene compared to the wild-type calreticulin gene, wherein said frameshift mutation is the deletion of one nucleotide or the addition of two nucleotides.

6. The method according to any one of items 1 to 5, wherein said mutant allele comprises a nucleic acid selected from the group consisting of (a) a nucleic acid encoding a polypeptide comprising an amino acid sequence as depicted in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288; 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;

(b) a nucleic acid comprising a nucleotide sequence as depicted in SEQ ID NO: 1, 5, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 291, 295, 299, 303, 307, 311, 315, 319, 323, 327, 331, 335, 339, 343, 347, 351, 355, 359, 363, 367, 371, 375, 379, 383, 387, 391, 395, 399, 403, 407, 411, 415, 419, 423, 427, or 431;

(c) a nucleic acid hybridizing under stringent conditions to the complementary strand of the nucleic acid as defined in (a) or (b);

(d) a nucleic acid comprising a nucleotide sequence with at least 70% identity to the nucleotide sequence of the nucleic acids of any one of (a) to (c); and (e) a nucleic acid comprising a nucleotide sequence which is degenerate as a result of the genetic code to the nucleotide sequence of a nucleic acid of any one of (a) to (d);

wherein said mutant allele is DNA, preferably genomic DNA.

7. A method for assessing whether a patient suffers from a myeloid malignancy or is prone to suffering from a myeloid malignancy, said method comprising determining the presence of a gene product of one or more mutant alleles of the calreticulin gene in a sample from said patient; and assessing that said patient suffers from a myeloid malignancy or is prone to suffering from a myeloid malignancy when said gene product is present.

8. The method according to item 7, wherein said one or more mutant alleles comprises a nucleic acid encoding a mutant calreticulin protein, wherein said mutant calreticulin protein is selected from the group consisting of (a) a protein encoded by a nucleic acid molecule having the nucleic acid sequence as depicted in SEQ ID NO: 1, 2 or 3;

(b) a protein comprising the amino acid sequence as shown in SEQ ID NO: 4;

(c) a protein encoded by a nucleic acid molecule encoding a protein comprising the amino acid sequence as shown in SEQ ID NO: 4;

(d) a protein comprising an amino acid sequence encoded by a nucleic acid hybridizing under stringent conditions to the complementary strand of nucleic acid molecules as defined in (a);

(e) a protein having at least 70% identity to the protein of any one of (a) to (d); and (f) a protein comprising an amino acid sequence encoded by a nucleic acid being degenerate as a result of the genetic code to the nucleotide sequence of a nucleic acid as defined in (a), (c) or (d).

9. The method according to item 7 or 8, wherein said mutant calreticulin protein is selected from the group consisting of (a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, 143, 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, 287, 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433;
- (b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
- (c) a protein encoded by a nucleic acid molecule encoding a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288, 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
- (d) a protein comprising an amino acid sequence encoded by a nucleic acid hybridizing under stringent conditions to the complementary strand of nucleic acid molecules as defined in (a);
- (e) a protein having at least 70% identity to the protein of any one of (a) to (e); and
- (f) a protein comprising an amino acid sequence encoded by a nucleic acid being degenerate as a result of the genetic code to the nucleotide sequence of a nucleic acid as defined in (a), (c) or (d).

10. The method according to any one of items 7 to 9, wherein said gene product is mRNA or protein.

11. A nucleic acid selected from the group consisting of
- (a) a nucleic acid encoding a polypeptide comprising an amino acid sequence as depicted in SEQ ID NO:4;
- (b) a nucleic acid comprising a nucleotide sequence as depicted in SEQ ID NO: 1, 2 or 3;
- (c) a nucleic acid hybridizing under stringent conditions to the complementary strand of the nucleic acid as defined in (a) or (b);
- (d) a nucleic acid comprising a nucleotide sequence with at least 70% identity to the nucleotide sequence of the nucleic acids of any one of (a) to (c); and
- (e) a nucleic acid comprising a nucleotide sequence which is degenerate as a result of the genetic code to the nucleotide sequence of a nucleic acid of any one of (a) to (d).

12. The nucleic acid according to item 11, wherein said nucleic acid is selected from the group consisting of
- (a) a nucleic acid encoding a polypeptide comprising an amino acid sequence as depicted in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288, 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;
- (b) a nucleic acid comprising a nucleotide sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, 143, 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, 287, 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433;
- (c) a nucleic acid hybridizing under stringent conditions to the complementary strand of the nucleic acid as defined in (a) or (b);
- (d) a nucleic acid comprising a nucleotide sequence with at least 70% identity to the nucleotide sequence of the nucleic acids of any one of (a) to (c); and
- (e) a nucleic acid comprising a nucleotide sequence which is degenerate as a result of the genetic code to the nucleotide sequence of a nucleic acid of any one of (a) to (d).

13. A protein selected from the group consisting of
- (a) a protein encoded by a nucleic acid molecule having the nucleic acid sequence as depicted in SEQ ID NO: 1, 2 or 3;
- (b) a protein comprising the amino acid sequence as shown in SEQ ID NO: 4;
- (c) a protein as defined in (a) or (b) wherein one or more amino acids are deleted, inserted, added or substituted;
- (d) a protein encoded by a nucleic acid molecule encoding a protein comprising the amino acid sequence as shown in SEQ ID NO: 4;
- (e) a protein comprising an amino acid sequence encoded by a nucleic acid hybridizing under stringent conditions to the complementary strand of nucleic acid molecules as defined in (a) or (c);

(f) a protein having at least 70% identity to the protein of any one of (a) to (e); and (g) a protein comprising an amino acid sequence encoded by a nucleic acid being degenerate as a result of the genetic code to the nucleotide sequence of a nucleic acid as defined in (a), (d) or (e).

14. The protein according to item 13, wherein said protein is selected from the group consisting of (a) a protein encoded by a nucleic acid molecule having the nucleic acid sequence as depicted in SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, or 143;

(b) a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;

(c) a protein encoded by a nucleic acid molecule encoding a protein comprising the amino acid sequence as shown in SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, or 144;

(d) a protein comprising an amino acid sequence encoded by a nucleic acid hybridizing under stringent conditions to the complementary strand of nucleic acid molecules as defined in (a);

(e) a protein having at least 70% identity to the protein of any one of (a) to (d); and (f) a protein comprising an amino acid sequence encoded by a nucleic acid being degenerate as a result of the genetic code to the nucleotide sequence of a nucleic acid as defined in (a), (c) or (d).

15. The protein according to item 13 or 14, wherein said protein is selected from the group consisting of (a) a protein encoded by a nucleic acid molecule having the nucleic acid sequence as depicted in SEQ ID NO: 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, 287, 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, or 433;

(b) a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288, 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;

(c) a protein encoded by a nucleic acid molecule encoding a protein comprising the amino acid sequence as shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288, 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434;

(d) a protein comprising an amino acid sequence encoded by a nucleic acid hybridizing under stringent conditions to the complementary strand of nucleic acid molecules as defined in (a);

(e) a protein having at least 70% identity to the protein of any one of (a) to (d); and (f) a protein having at least 70% identity to the protein of any one of (a) to (e); and (g) a protein comprising an amino acid sequence encoded by a nucleic acid being degenerate as a result of the genetic code to the nucleotide sequence of a nucleic acid as defined in (a), (c) or (d).

16. The protein according to item 13 or 14, such as a protein consisting of 15 to 25 contiguous amino acids of the protein as shown in SEQ ID NO: 4, for use as vaccine.

17. An antibody specifically binding to the protein of item 13 or 14.

18. An inhibitor of a mutant calreticulin for use in the treatment of primary myelofibrosis (PMF), essential thrombocythemia (ET), or refractory anemia with ringed sideroblasts and thrombocythemia (RARS-T) for use in the treatment of primary myelofibrosis (PMF), essential thrombocythemia (ET), or refractory anemia with ringed sideroblasts and thrombocythemia (RARS-T); or the protein for use as a vaccine according to item 16 in the treatment of primary myelofibrosis (PMF), essential thrombocythemia (ET), or refractory anemia with ringed sideroblasts and thrombocythemia (RARS-T);

wherein said mutant calreticulin is a mutant calreticulin protein as defined in any one of items 12 to 14.

19. The inhibitor according to item 18, wherein said inhibitor is an inhibitory antibody.

EXAMPLES

The present invention is further described by reference to the following non-limiting figures and examples that illustrates the invention.

Example 1

Somatic Mutations of Calreticulin in Primary Myelofibrosis and Essential Thrombocythemia Material and Methods Patient Sampling We studied patients with Philadelphia chromosome-negative myeloproliferative neoplasms followed at the Medical University of Vienna, Austria, and the Department of Hematology Oncology, Fondazione IRCCS Policlinico San Matteo, Pavia, Italy. The investigations have been approved by the ethics committees of both institutions, and all patients provided written informed consent. Diagnosis of polycythemia vera, essential thrombocythemia and primary myelofibrosis was done according to the 2008 criteria of the World Health Organization (Sverdlow et al, 2008).

Diagnostic Criteria

Diagnosis of polycythemia vera, essential thrombocythemia and primary myelofibrosis was done according to the criteria in use at the time of the first observation, as previously reported (Passamonti et al. 2004). In 2002 the criteria of the World Health Organization (WHO) were adopted (Vardiman et al, 2002) and in 2008 their revision was implemented (Swerdlow et al, 2008). JAK2 and MPL mutation analyses were performed as previously described (Passamonti et al, 2010a; Rumi et al, 2013; Passamonti et al, 2011) in Pavia and as outlined below in Vienna. Bone marrow fibrosis was assessed semi-quantitatively following the European consensus guidelines (Thiele et al, 2005). Thrombotic events were defined as described in detail previously (Marchioli et al, 2013). Patients were treated according to the recommendations that have been formalized by the European Leukemia Net in 2011 (Barbui et al, 2011)

Assessment of JAK2-V617F, JAK2-Exon 12 and MPL-W515L Mutations in Vienna

An allele specific PCR assay was used to detect the JAK2-V617F mutation. A primer mix consisting of 4 µM of a common forward primer (gtttcttAGTGCATCTTTATTATG-GCAGA (SEQ ID NO: 1340)), 2 µM of a reverse primer specific for the wild type allele (TTACTCTCGTCTCCACA-GAC (SEQ ID NO: 1341)) and 2 µM of a reverse primer specific for the mutant allele (aaaTTACTCTCGTCTCCA-CAGAA (SEQ ID NO: 1342)) was prepared. The two reverse primers were fluorescently labeled with 6-carboxyfluorescein (6-FAM) on the 5' end. A PCR reaction was set up using the AmpliTaq Gold DNA Polymerase with Gold Buffer and $MgCl_2$ (Applied Biosystems) containing 1.1 µl of the 10×PCR GOLD buffer, 0.66 µl of 25 mM $MgCl_2$, 0.44 µl of 2.5 mM dNTPs, 1.4 µl of the primer mix, 0.05 µl of the AmpliTaq Gold polymerase (5 U/µl), 6.36 µl $H_2O$ and 1 µl genomic DNA (10 ng/µl). PCR was performed as follows: 95° C. for 5 min—36× (94° C. for 30 sec, 62.2° C. for 30 sec, 72° C. for 30 sec)—72° C. for 15 min—8° C. hold. The PCR products were sized on a 3130×1 Genetic Analyzer (Applied Biosystems) and the data were analyzed using Gene Mapper software (Applied Biosystems).

The assay used to detect mutations in JAK2 exon 12 was reported before (Li et al, 2008)

For testing for the MPL-W515L the following allele specific PCR assay was used. A primer mix consisting of 8 µM of a common forward primer (GTTTCTTCCGAAGTCTGAC-CCTTTTTG (SEQ ID NO: 1343)), 4 µM of a reverse primer specific for the wild type allele (GTAGTGTGCAG-GAAACTGCC (SEQ ID NO: 1344)) and 4 µM of a reverse primer specific for the mutant allele (AAAGTAGTGTG-CAGGAAACTGCA (SEQ ID NO: 1345)) was prepared. The two reverse primers were fluorescently labeled with 6-carboxyfluorescein (6-FAM) on the 5' end. A PCR reaction was set up as described above for JAK2-V617F mutation. PCR was performed as follows: 94° C. for 10 min—30× (94° C. for 30 sec, 62.2° C. for 30 sec, 72° C. for 30 sec)—72° C. for 15 min—8° C. hold. The PCR products were sized on a 3130×1 Genetic Analyzer (Applied Biosystems) and the data were analyzed using Gene Mapper software (Applied Biosystems).

Whole Exome Sequencing

Genomic DNA was isolated from peripheral blood granulocytes (tumor tissue) and $CD3^+$ T-lymphocytes (control tissue) according to standard procedures. DNA libraries were generated using the NEB Next DNA Sample prep kit (reagent set) (New England Biolabs, Ipswich, Mass.) and whole-exome enrichment was performed using the Sure Select Human All Exon kit (Agilent, Santa Clara, Calif.) according to the manufacturers instructions. The libraries were sequenced on an Illumina HiSeq2000 system (Illumina, San Diego, Calif.) following the manufacturers recommendations. See Table 3 for details on whole-exome sequencing parameters.

TABLE 3

| sample_ID | gDNA source | sequencing parameters | total reads | mean coverage | exonic bases covered at least | | | |
|---|---|---|---|---|---|---|---|---|
| | | | | | 2X | 10X | 20X | 30X |
| H_0010B_GD | granulocytes | 52 bp PE, 51 bp PE | 440,507,278 | 230 | 93.92% | 82.95% | 80.45% | 78.86% |
| H_0010B_TD | T-lymphocytes | 70 bp SR, 75 bp PE | 305,708,053 | 187 | 95.67% | 87.27% | 82.73% | 79.58% |
| H_0191B_GD | granulocytes | 70 bp SR, 51 bp PE | 329,139,581 | 163 | 95.93% | 88.71% | 84.26% | 81.04% |
| H_0191A_TD | T-lymphocytes | 70 bp SR, 75 bp PE | 300,420,257 | 173 | 95.55% | 88.26% | 84.01% | 80.81% |
| H_0202B_GD | granulocytes | 70 bp SR, 51 bp PE | 286,094,080 | 149 | 95.41% | 87.81% | 83.32% | 79.84% |
| H_0202B_TD | T-lymphocytes | 70 bp SR, 75 bp PE | 262,563,166 | 160 | 95.25% | 87.80% | 83.44% | 80.01% |
| H_0296C_GD | granulocytes | 70 bp SR, 51 bp PE | 279,769,005 | 138 | 95.17% | 87.45% | 82.68% | 78.78% |
| H_0296C_TD | T-lymphocytes | 70 bp SR, 75 bp PE | 266,487,695 | 158 | 95.34% | 87.79% | 83.36% | 79.83% |
| H_0333B_GD | granulocytes | 70 bp SR, 51 bp PE | 293,076,867 | 156 | 95.65% | 88.23% | 83.79% | 80.41% |
| H_0333B_TD | T-lymphocytes | 70 bp SR, 75 bp PE | 260,476,597 | 155 | 94.99% | 87.47% | 83.03% | 79.50% |
| H_0386B_GD | granulocytes | 70 bp SR, 51 bp PE | 285,286,604 | 148 | 95.58% | 88.00% | 83.48% | 79.96% |
| H_0386B_TD | T-lymphocytes | 70 bp SR, 75 bp PE | 266,364,404 | 162 | 95.18% | 87.69% | 83.39% | 79.98% |
| minimum | | | 260,476,597 | 138 | 93.92% | 82.95% | 80.45% | 78.78% |
| maximum | | | 440,507,278 | 230 | 95.93% | 88.71% | 84.26% | 81.04% |
| average | | | 297,991,132 | 165 | 95.30% | 87.45% | 83.16% | 79.88% | gDNA, genomic DNA;
bp, base pairs;
PE, paired-end;
SR single read

TABLE 4

Primers used to analyze the mutational status of CALR

| application | targeted CALR exon | forward primer sequence | reverse primer sequence |
|---|---|---|---|
| Sanger sequencing/ PCR product subcloning | 9 | ACAACTTCCTCATCACCAACG (SEQ ID NO: 437) | GGCCTCAGTCCAGCCCTG (SEQ ID NO: 438) |
| PCR fragment analysis | 9 | GGCAAGGCCCTGAGGTGT (SEQ ID NO: 439) | GGCCTCAGTCCAGCCCTG (SEQ ID NO: 438) |
| Sanger sequencing | 1 | GTCAGGTTGGTTTGAGAGGC (SEQ ID NO: 1310) | GCTAACCCTAACTCCCGCC (SEQ ID NO: 1311) |
| Sanger sequencing | 2 | GGATCTCCTTTCCTGTCCCC (SEQ ID NO: 1312) | CCACCTGTCCTCCTCCAAG (SEQ ID NO: 1313) |
| Sanger sequencing | 3 | GAGGACAGGTGGAGGAAGTG (SEQ ID NO: 1314) | AAATTGTTGCTGGGACTTATTC (SEQ ID NO: 1315) |
| Sanger sequencing | 4 | CAGACCCGAGTTGAAGAACC (SEQ ID NO: 1316) | AGAAGGAAGAAGGTGAGCGG (SEQ ID NO: 1317) |
| Sanger sequencing | 5 | CTGATCAACAAGGACATCCG (SEQ ID NO: 1318) | CTCGGGCTTCTTAGCATCAG (SEQ ID NO: 1319) |
| Sanger sequencing | 6-7 | AAGCCTGAGGTTGGTGTTTG (SEQ ID NO: 1320) | CTCACCTGGGGTGCCTACC (SEQ ID NO: 1321) |
| Sanger sequencing | 8 | GTGTCAGCGGTGTTCCTTG (SEQ ID NO: 1322) | TTAAGCCTCTGCTCCTCGTC (SEQ ID NO: 1323) |

Whole-Exome Sequencing Analysis

The sequencing reads were aligned against the human reference genome (hg18) using BWA v0.5.9 (Li & Durbin, 2009). The genome analysis toolkit (GATK) v1.5 (McKenna et al, 2010) was used to post-process the alignments according to the best practices guidelines v3 of GATK. The coverage data presented in TABLE 3 were calculated from the post-processed alignment files using the CalculateHsMetrics.jar script from Picard (http://picard.sourceforge.net). The post-processed alignment files were further analyzed by two variant callers:

1. GATK's Unified Genotyper (DePristo et al, 2011) was used to call single nucleotide variants and small insertions/deletions from the granulocyte DNA samples. The preliminary variant lists were further processed using the Variant Quality Score Recalibrator (GATK) to generate recalibrated variant lists. The variants were annotated using ANNOVAR version 2012 May 25 (Wang et al, 2010). We filtered for variants that are found in coding exons and that affect the amino acid composition of the protein, as well as for variants at splice sites.

2. The Varscan 2.3.2 tool (Koboldt et al, 2012) was used to call somatic variants comparing post-processed alignments from the granulocyte DNA sample with the alignments from the T-lymphocyte sample of the same patient. Varscan was used according to the programmer's instructions. Samtools 0.1.18 (Li et al, 2009) generated the mpileup files needed as the input for Varscan. Varscan hit lists were annotated by ANNOVAR and filtered as described above. Intersecting the variant lists retrieved from the two variant calling pipelines, as follows, generated final variant lists. GATK provides a score for the likelihood of a variant to be a true variant, which is the VQSLOD score. Varscan provides a p-value for a variant to be somatic. Basic requirements for final single nucleotide variant (SNV) calling were that the variants had to be called by both variant-calling pipelines and that the variant in the granulocyte sample was not classified as "low quality" by GATK. From all SNVs falling into this category, all those were called which had a VQSLOD score >0 and a somatic p-value of <0.05. We also called variants with a VQSLOD [−2;0] but required a somatic p-value of <0.01 for those. Insertion/deletion variant calling is more complex than SNV calling. In order not to miss true variants, we just required an insertion/deletion to be found by both pipelines. No further quality measures or p-values were required to call these variants.

Sanger Sequencing

Primers for Sanger Sequencing were designed using the PrimerZ tool (http://ncbi36.genepipe.ncgm.sinica.edu.tw/primerz/beginDesign.do) or the Primer3 tool (http://www.bioinformatics.nl/cgi-bin/primer3plus/primer3plus.cgi/). Primer sequences are listed in TABLE 4.

PCRs were performed using the AmpliTaq Gold 360 Mastermix (Applied Biosystems/Life Technologies, Paisley, UK).

A touchdown program was used for the PCR: 95° C., 5 min—10× (94° C., 30 sec—67° C., 30 sec [−1° C. per cycle]—72° C., 30 sec.)—29× (94° C., 30 sec—57° C., 30 sec—72° C., 30 sec)—72° C., 10 min. 10° C., hold. For Sanger Sequencing the BigDye Terminator v3.1 Cycle Sequencing kit (Applied Biosystems) was used with the following program: 96° C., 1 min.—25× (96° C., 10 sec.—50° C., 5 sec.—60° C., 4 min.)—10° C. hold. Sequencing traces were read on a 3130×1 Genomic Analyzer (Genetic Analyzer) ((Applied Biosystems). Sequence analysis was done using the Sequencher Software 4.9 (Gene Codes, Ann Arbor, Mich.)

PCR Fragment Analysis for Detection of CALR-Exon9 Mutations

Primers were designed for CALR exon 9 and the forward primer was 6-FAM labeled (TABLE 4). PCR was performed as follows: 95° C., 10 min.—10× (94° C., 15 sec.—55° C., 15 sec.—72° C., 30 sec.)—20× (89° C., 15 sec.—55° C., 15 sec.—72° C., 30 sec.)—72° C., 20 min—10° C., hold. PCR products were diluted 1:25 in water and sized on a 3130×1 Genomic Analyzer (Genetic Analyzer) (Applied Biosystems). The results were analyzed using the Gene Mapper software version 4.0 (Applied Biosystems).

PCR Product Subcloning

PCR products were subcloned with the TOPO TA cloning kit (Invitrogen/Life Technologies, Paisley, UK) following the manufacturer's instructions using TOP-10 bacteria. Single bacterial colonies were picked the following day and expanded in an over-night culture. Plasmids were extracted with the QIAprep Spin Mini Prep kit (Qiagen, Hilden, Germany). A sequencing reaction was set up using the BigDye Terminator v3.1 Cycle Sequencing kit (Applied Biosystems): 50-200 ug plasmid, 4 ul Primer, 1 ul BigDye Terminator mix, 1 ul sequencing buffer and HPLC water up to 10 ul. The sequencing program was 96° C., 5 min.—25× (96° C., 1 min.—50° C., 5 sec.—60° C., 4 min.)—10° C. hold.

SNP Microarray Analysis

DNA samples were processed and hybridized to Genome-Wide Human SNP 6.0 arrays (Affymetrix) according to the protocol supplied by the manufacturer. The raw data was analyzed by Genotyping Console version 3.0.2 software (Affymetrix). The samples were assessed for chromosomal aberrations (deletions, gains and acquired uniparental disomies) as implemented in the Genotyping Console software.

Cloning of CALR Exon 9 Mutations

The wild type and mutant CALR was amplified from the clone purchased from Source Biosciences and cloned into the XhoI and EcoRI sites in the retroviral construct pMSCV-IRES-GFP. The wild type CALR was amplified using the following primers—
(FP—ATGCCTCGAGCCGCCACCATGCTGC-TATCCGTGCCGCTGCTGCTC (SEQ ID NO: 1346) and RP—ATGCGAATTCCTACAGCTCGTCCTTGGC-CTGGCC (SEQ ID NO: 1347)).

The mutant CALR was amplified in two fragments followed by nested PCR—
(FP1—ATGCCTCGAGCCGCCACCATGCTGC-TATCCGTGCCGCTGCTGCTC (SEQ ID NO: 1346), RP1—CCTCATCATCCTCCTTGTCCTCTGCTC-CTCGTCCTG (SEQ ID NO: 1348), FP2—CAGGACGAGGAGCAGAGGACAAGGAG-GATGATGAGG (SEQ ID NO: 1349), RP2—ATGCCCGCGGCTAGGCCTCAGTCCAGC-CCTGGAGG) (SEQ ID NO: 1350).

Virus Production and Transduction

The retrovirus was generated and cells were transduced as described before (Zuber et al, 2013). Briefly, PlatE cells (75% confluent in a 10 cm dish) were transfected with 20 µg of the respective viral vector using the Calcium Phosphate Transfection Kit (Sigma #CAPHOS). The medium was changed after 24 hours and viral supernatant was collected at 36, 40, 44 and 60 hours after transfection. 1 million Ba/F3 cells were transduced with the fresh viral supernatant, in 6 well plates by spinoculation (4 µg/ml of polybrene, 1350 g, 30 minutes at 32° C.), at every virus collection point. The cells were analyzed for transduction efficiency by flow cytometry, 48 hours after the final transduction step. The GFP positive cells were sorted by FACS and the sorting efficiency was analyzed by flow cytometry.

Proliferation and Viability Assays

To assess the viability of transduced Ba/F3 cells in presence of interleukin-3, cells were plated in 96-well plates at 5000 cells per well in triplicates on a dilution series of interleukin-3 (highest dose 25 ng/ml). After 72 hours cell viability was determined by the CellTiter-Glo® Luminescent Cell Viability Assay (Promega).

To determine cell proliferation in the absence of interleukin-3, Ba/F3 cells were plated in 12-well plates at 1000000 cells per well in triplicates and cultured for 7 days in complete RPMI (with 10% FCS, Pen/Strep and L-glutamine) without interleukin-3. Every 24 hours cell number was assessed using CASY® Cell Counter (Roche Innovatis).

To define the sensitivity to the inhibitor SAR302503 (Sanofi), Ba/F3 cells were plated in 96-well plates at 25000 cells per well in triplicates on a dilution series of SAR302503 (highest concentration 40 µM) and in presence of 10 ng/ml interleukin-3. After 48 hours cell viability was determined by the CellTiter-Glo® Luminescent Cell Viability Assay (Promega).

Interleukin-3 Stimulation and Western Blotting

Ba/F3 cells were cultured in complete RPMI (10% FCS, Pen/Strep, L-glutamine) in the presence of 1 ng/ml of interleukin-3. Cells were starved in serum free medium without interleukin-3 for 4 hours. Stimulation was performed with respective concentration of interleukin-3, for 20 minutes. The cells were pelleted and protein extraction was done as described before (Corvinus et al, 2005). Briefly, complete whole cell extract buffer (containing the protease and phosphatase inhibitors) was added to the cells, and lysis was done by 3 consecutive freeze-thaw cycles with liquid Nitrogen. Lysates were collected after centrifugation for 20 minutes at 20,000 g. Protein concentration was measured using the Bradford reagent. Western blot was performed by standard techniques and 50 µg of protein was loaded per well. The following antibodies were used—pYStat5 (Invitrogen, #71-6900), Stat5 (Santa Cruz, sc-836), Calreticulin (Millipore, MABT145), GAPDH (Santa Cruz, sc-32233), anti-rabbit HRP (GE, NA934) and anti-mouse HRP (GE, NA931).

Immunofluorescence

HEK293T cells were seeded on glass coverslips coated with 0.1% gelatin transfected with the CMV-CALR wt and CMV-CALR del52 plasmids by lipofection (Invitrogen), according to the manufacturer's instructions, for 24 hours. ER staining was visualized using anti-Calnexin (ab31290, abcam); secondary anti-mouse AlexaFluor 546 (Invitrogen). Anti-Calreticulin antibody (MABT145, Millipore) was used to stain CALR; secondary anti-rabbit AlexaFlour 594 (Invitrogen). Slides were visualized using an LSM780 (Carl Zeiss, Germany) with a GaAsP multi-detector unit and two PMTs. Pinhole was set to 1AU on each channel. Images were taken sequentially, and channels selected, to reduce overlap. Images were taken at 100× and analyzed with ImageJ (NIH, open source.).

Statistical Analysis

Statistical analysis was performed with the use of standard methods. Hypothesis testing was carried out with a non-parametric approach. All tests were two-tailed and P-values were considered significant when lower than 0.05. Microsoft Office Excel (Copyright Microsoft Corp), Stata 11.2 (Copyright StataCorp LP) and R 2.15.2 (R Core Team, 2012) were used for data management and analysis. The cumulative incidence of thrombotic complications was estimated with a competing risk approach according to the Kalbfleisch-Prentice method (Kalbfleisch & Prentice, 1980). Death in absence of the event of interest was considered as a competing event.

Results

Whole Exome Sequencing Reveals Recurrent Mutations of CALR in PMF (Primary Myelofibrosis)

Figure 1:
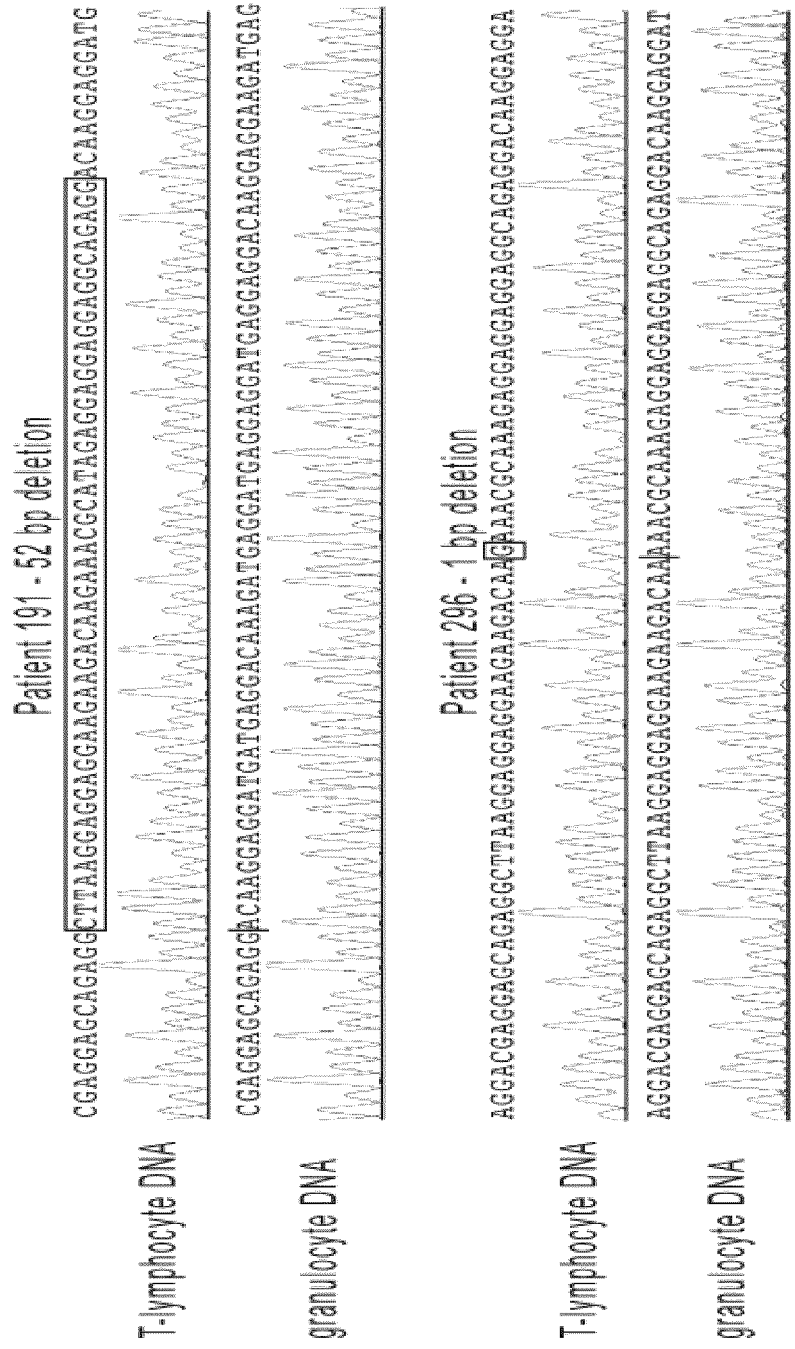
FIG. 1. Validation of CALR gene mutations in patients 191 and 296 by Sanger sequencing. Depicted are Sanger sequencing traces. Boxes around the sequence letters mark the bases that are lost due to the deletion events.

Genomic DNA from peripheral blood granulocytes (tumor tissue) and CD3[+] T-lymphocytes (control tissue) from 6 patients with PMF was analyzed using whole exome sequencing. Independent validation of the detected variants using classical Sanger sequencing confirmed somatic mutations in between two and twelve genes per patient. The only recurrently affected gene was CALR encoding calreticulin. Two patients harbored somatic deletions in exon 9 of CALR. PCR product subcloning and sequencing revealed that patient 191 had a 52 base pair deletion and patient 296 harbored a one base pair deletion (FIG. 1). As the 52 base pair deletion in patient 191 was incorrectly annotated as a one base pair deletion coupled with a single nucleotide variant by our variant calling analysis pipeline the sequence alignment of patient 191 was manually reviewed. A misalignment of the sequencing reads covering the site of mutation was observed. The incorrect alignment was due to a repetitive element in the affected genomic region. Following up on this finding the sequence alignments for the remaining four patients were investigated and a recurrent 5 bp insertion was detected in all 4 patients. The mutations of CALR found in the patients by whole exome sequencing were confirmed to be somatic by Sanger sequencing of the matched T-lymphocyte DNA samples. In summary, all six PMF patients analyzed by whole exome sequencing harbored somatic insertion or deletion mutations in exon 9 of CALR.

Frequency of CALR Exon 9 Mutations in Myeloproliferative Neoplasm (MPN) Patients In order to estimate the prevalence of CALR mutations in MPN a cohort of 896 MPN patients was screened for insertion and deletion mutations in CALR exon 9 using high-resolution sizing of fluorescent dye-labelled PCR products. This cohort included 382 patients with polycythemia vera (PV), 311 with essential thrombocythemia (ET) and 203 with primary myelofibrosis (PMF) (TABLE 5). 150 samples harboring insertions or deletions in CALR (17%) were identified. The mutations have been independently validated by Sanger sequencing. In PV no CALR mutations were observed. In ET and PMF, 78 (25%) and 72 (35%) patients had mutations in CALR, respectively (TABLE 5). All patients were genotyped for the JAK2-V617F mutation. PV patients negative for this mutation were tested for mutations in JAK2 exon 12. ET and PMF patients with wildtype JAK2 were tested for mutations in MPL exon 10.

Figure 2A:
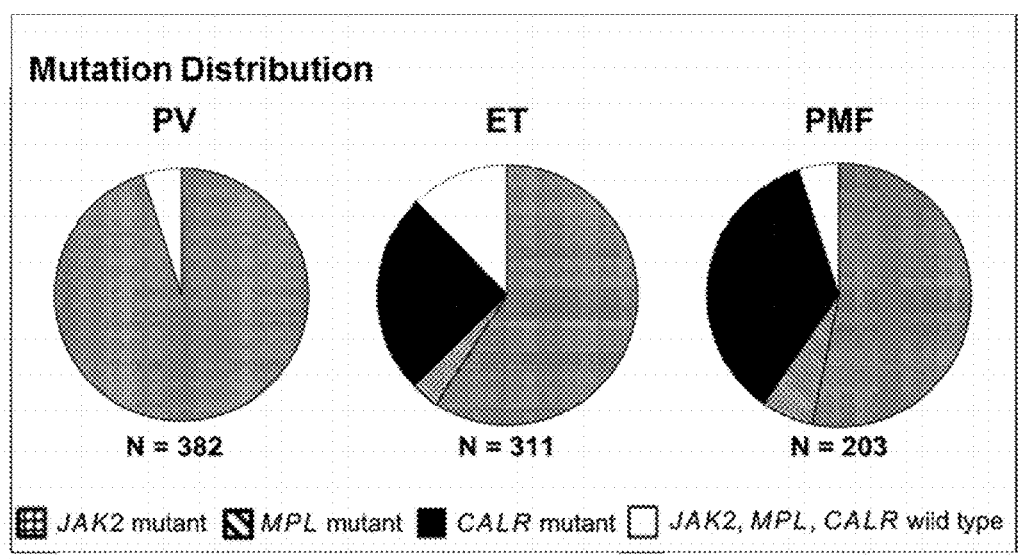
FIGS. 2A-C. Frequency of CALR mutations in myeloid malignancies.

The distribution of JAK2, MPL and CALR mutations in the three MPN disease entities is depicted in FIG. 2A. All patients with mutant CALR had wild type JAK2 and MPL. Therefore, mutations in CALR significantly associate with ET (P=9.33× $10^{-45}$) and PMF (P=1.71×$10^{-44}$) that are wild type for JAK2 and MPL mutations. A total of 67 MPN patients tested wild type for JAK2 and MPL as well as for CALR exon 9. Of these "triple-negative" cases, 19 patients were Sanger sequenced for mutations in all 9 exons of CALR but no mutations were detected.

As CALR mutations were highly associated with JAK2 and MPL wild type ET or PMF, another 211 patients falling into this disease category were analyzed. In total, of 289 JAK2/MPL wild type ET patients 195 had mutant CALR (67%). Of the combined 120 JAK2/MPL wild type PMF patients, 105 had a mutation in CALR (88%). In 150 patients with mutant CALR for whom we had matched T-lymphocyte DNA available, the mutations were somatic.

TABLE 5

Comparison of JAK2, MPL, and CALR mutations in the three subtypes of MPN (number of patients are shown).

| MPN subtype | N | JAK2 mutant | MPL mutant | CALR mutant | JAK2/MPL/CALR wild type |
|---|---|---|---|---|---|
| ET | 311 | 184 | 11 | 78 | 38 |
| PMF | 203 | 108 | 13 | 72 | 10 |
| PV | 382 | 363 | 0 | 0 | 19 |
| total: | 896 | 655 | 24 | 150 | 67 |

Frequency of CALR Mutations in Other Myeloid Malignancies

Figure 2B:
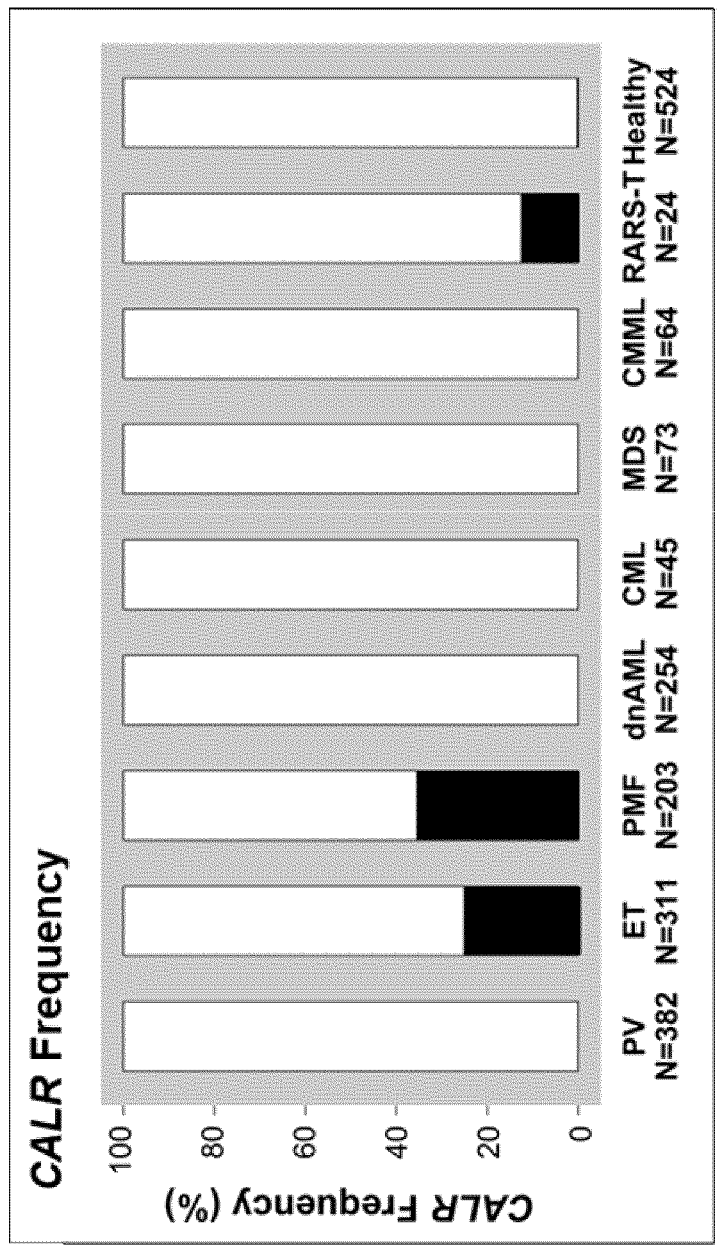
Figure 2C:
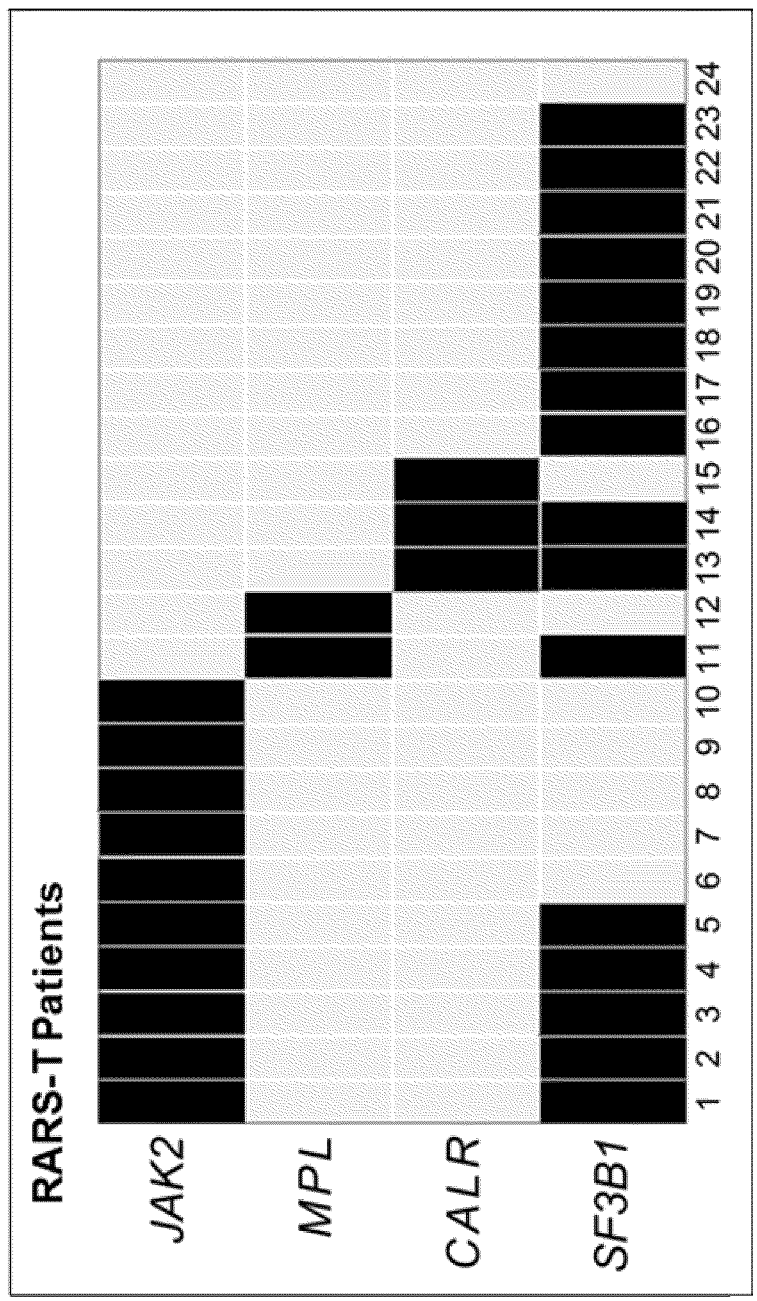

To investigate if CALR mutations are present in other myeloid malignancies we screened 254 patients with de novo AML, 45 with chronic myeloid leukemia, 73 with myelodysplastic syndrome, 64 with chronic myelomonocytic leukemia and 24 with refractory anemia with ringsideroblasts associated with marked thrombocytosis for mutations in CALR exon 9. While the vast majority of these patients had wild type CALR exon 9, three patients with refractory anemia with ring sideroblasts associated with marked thrombocytosis harbored mutations in CALR (FIG. 2B), all of them having wild-type JAK2 and MPL (FIG. 2C). Mutations in the gene encoding splicing factor 3B, subunit 1 (SF3B1) co-occurred with mutations in all three genes. Out of 524 healthy subjects one had a 3 bp in-frame deletion in CALR.

CALR Frameshift Mutations Substitute the C-Terminal Amino Acid Sequence with a Novel Peptide Derived from an Alternative Reading Frame A total of 36 different types of mutations in CALR including insertions, deletions, combinations of deletions and insertions, as well as combinations of insertions/deletions with single nucleotide variants was detected. All observed mutations result in a frameshift to the alternative reading frame 1 of CALR (FIG. 3A). This leads to a marked change in the amino acid composition of the C-terminus of the mutant CALR protein (FIG. 3B). The C-terminus derived from exon 9 in wild type CALR is highly negatively charged, whereas the peptides of the mutants derived from the alternative reading frame 1 are positively charged. As the alternative reading frame 2 has a number of stop codons, frameshift mutations into this frame would result in a premature termination of translation and truncation of the protein (FIG. 3B). No frameshift mutations into the alternative reading frame 2 were observed in the MPN patients studied. The 36 types of mutations are depicted in FIG. 3C. Due to the different sizes and positions of the mutations gains and losses of variable numbers of amino acids are found at the C-terminal region of the protein (TABLE 6). All frameshift mutations generate a novel C-terminal amino acid sequence (TABLE 6). Full-length protein sequences of all mutants are shown in SEQ ID NO: 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288. The cDNA sequences around the mutation junctions are provided in TABLE 7.

TABLE 6

C-terminal amino acid sequences of insertion/deletion frameshift mutations of CALR found in MPN patients. Table 6 discloses SEQ ID NOS 8, 12, 16, 20, 24, 28, 32, 36, 40, 44, 48, 52, 56, 60, 64, 68, 72, 4, 76, 80, 84, 88, 92, 96, 100, 104, 108, 112, 116, 120, 124, 128, 132, 136, 140, and 144, respectively, in order of appearance.

| | |
|---|---|
| Type 1 | TRRMMRTKMRMRRMRRTRRKMRRKMSPARPRTSCREACLQGWTEA- |
| Type 2 | NCRRMMRTKMRMRRMRRTRRKMRRKMSPARPRTSCREACLQGWTEA- |
| Type 3 | QRTRRMMRTKMRMRRMRRTRRKMRRKMSPARPRTSCREACLQGWTEA- |
| Type 4 | RRRQRTRRMMRTKMRMRRMRRTRRKMRRKMSPARPRTSCREACLQGWTEA- |
| Type 5 | GQRTRRMMRTKMRMRRMRRTRRKMRRKMSPARPRTSCREACLQGWTEA- |
| Type 6 | RRQRTRRMMRTKMRMRRMRRTRRKMRRKMSPARPRTSCREACLQGWTEA- |
| Type 7 | RRMMRTKMRMRRMRRTRRKMRRKMSPARPRTSCREACLQGWTEA- |
| Type 8 | RRQRTRRMMRTKMRMRRMRRTRRKMRRKMSPARPRTSCREACLQGWTEA- |
| Type 9 | RQRTRRMMRTKMRMRRMRRTRRKMRRKMSPARPRTSCREACLQGWTEA- |
| Type 10 | MCRRMMRTKMRMRRMRRTRRKMRRKMSPARPRTSCREACLQGWTEA- |
| Type 11 | DQRQRTRRMMRTKMRMRRMRRTRRKMRRKMSPARPRTSCREACLQGWTEA- |
| Type 12 | RRRRQRTRRMMRTKMRMRRMRRTRRKMRRKMSPARPRTSCREACLQGWTEA- |
| Type 13 | QRRRQRTRRMMRTKMRMRRMRRTRRKMRRKMSPARPRTSCREACLQGWTEA- |
| Type 14 | RRRQRTRRMMRTKMRMRRMRRTRRKMRRKMSPARPRTSCREACLQGWTEA- |
| Type 15 | RRRERTRRMMRTKMRMRRMRRTRRKMRRKMSPARPRTSCREACLQGWTEA- |
| Type 16 | QRRQRTRRMMRTKMRMRRMRRTRRKMRRKMSPARPRTSCREACLQGWTEA- |
| Type 17 | RRQWTRRMMRTKMRMRRMRRTRRKMRRKMSPARPRTSCREACLQGWTEA- |
| Type 18 | RMMRTKMRMRRMRRTRRKMRRKMSPARPRTSCREACLQGWTEA- |
| Type 19 | RQRTRRMMRTKMRMRRMRRTRRKMRRKMSPARPRTSCREACLQGWTEA- |
| Type 20 | GRRQRTRRMMRTKMRMRRMRRTRRKMRRKMSPARPRTSCREACLQGWTEA- |
| Type 21 | AFKRTRRMMRTKMRMRRMRRTRRKMRRKMSPARPRTSCREACLQGWTEA- |
| Type 22 | NAKRRRQRTRRMMRTKMRMRRMRRTRRKMRRKMSPARPRTSCREACLQGWTEA- |
| Type 23 | CVRRRQRTRRMMRTKMRMRRMRRTRRKMRRKMSPARPRTSCREACLQGWTEA- |
| Type 24 | RRQRTRRMMRTKMRMRRMRRTRRKMRRKMSPARPRTSCREACLQGWTEA- |
| Type 25 | RQRTRRMMRTKMRMRRMRRTRRKMRRKMSPARPRTSCREACLQGWTEA- |
| Type 26 | NAKRRRQRTRRMMRTKMRMRRMRRTRRKMRRKMSPARPRTSCREACLQGWTEA- |
| Type 27 | CFAKRRRQRTRRMMRTKMRMRRMRRTRRKMRRKMSPARPRTSCREACLQGWTEA- |
| Type 28 | RRMMRTKMRMRRMRRTRRKMRRKMSPARPRTSCREACLQGWTEA- |
| Type 29 | PPLCLRRMMRTKMRMRRMRRTRRKMRRKMSPARPRTSCREACLQGWTEA- |
| Type 30 | DHPCRRMMRTKMRMRRMRRTRRKMRRKMSPARPRTSCREACLQGWTEA- |
| Type 31 | GNCRRMMRTKMRMRRMRRTRRKMRRKMSPARPRTSCREACLQGWTEA- |
| Type 32 | CRRMMRTKMRMRRMRRTRRKMRRKMSPARPRTSCREACLQGWTEA- |
| Type 33 | CRRMMRTKMRMRRMRRTRRKMRRKMSPARPRTSCREACLQGWTEA- |
| Type 34 | TCRRMMRTKMRMRRMRRTRRKMRRKMSPARPRTSCREACLQGWTEA- |
| Type 35 | ICRRMMRTKMRMRRMRRTRRKMRRKMSPARPRTSCREACLQGWTEA- |
| Type 36 | CRRMMRTKMRMRRMRRTRRKMRRKMSPARPRTSCREACLQGWTEA- |

TABLE 7

Sequences of mutation junctions in the cDNA sequence
of CALR for the design of mutation specific probes
or PCR primers. Table 7 discloses SEQ ID NOS 440-475,
respectively, in order of appearance.

| CALR mutation | cDNA junction sequences in mutated positions |
|---|---|
| Type 1 | GAAGGACAAACAGGACGAGGAGCAGAGGACAAGGAGGATGAT |
| Type 2 | GAGGAGGAGGCAGAGGACAA<u>TTGTC</u>GGAGGATGATGAGGACAAAG |
| Type 3 | GGACAAACAGGACGAGGAGCAGAGGCAGAGGACAAGGAGGAT |
| Type 4 | CAGGACGAGGAGCAGAGGCTTAGGAGGAGGCAGAGGACAAGG |
| Type 5 | TGAAGGACAAACAGGACGAGGGGCAGAGGACAAGGAGGATGA |
| Type 6 | AGGACAAACAGGACGAGGAGCCGGAGGCAGAGGACAAGGAGGA |
| Type 7 | CAGGACGAGGAGCAGAGGCTTAGGAGGATGATGAGGACAAAG |
| Type 8 | GGACGAGGAGCAGAGGCTTAAGAGGAGGCAGAGGACAAGGAG |
| Type 9 | CAAGAAACGCAAGAGGAGGAGAGGCAGAGGACAAGGAGGAT |
| Type 10 | AGGAGGAGGAGGCAGAGGAC<u>ATGTGTC</u>GGAGGATGATGAGGACAAAG |
| Type 11 | AAGGACAAACAGGACGAGGA*C*CAGAGGCAGAGGACAAGGAGGAT |
| Type 12 | CAAACAGGACGAGGAGCAGAGGAGGAGGAGGAGGCAGAGGAC |
| Type 13 | AACAGGACGAGGAGCAGAGGC<u>AG</u>AGGAGGAGGCAGAGGACAAG |
| Type 14 | ACAGGACGAGGAGCAGAGGCTGAGGAGGAGGCAGAGGACAAG |
| Type 15 | CAGGACGAGGAGCAGAGGCTTAGGAGGAG*G*AGAGGACAAGGAGGATGATG |
| Type 16 | CAGGACGAGGAGCAGAGGCTT<u>CA</u>GAGGAGGCAGAGGACAAGGAG |
| Type 17 | GGACGAGGAGCAGAGGCTTAAGAGGAGGCAG*T*GGACAAGGAGGATGATGAGG |
| Type 18 | GGACGAGGAGCAGAGGCTTAAGAGGATGATGAGGACAAAGAT |
| Type 19 | GGAGCAGAGGCTTAAGGAGGAGAGGCAGAGGACAAGGAGGAT |
| Type 20 | GGCTTAAGGAGGAGGAAGAAGGGAGGAGGCAGAGGACAAGGA |
| Type 21 | GGCTTAAGGAGGAGGAAGAAG<u>CGTTTA</u>AGAGGACAAGGAGGATGATGA |
| Type 22 | CTTAAGGAGGAGGAAGAAGACAACGCAAAGAGGAGGAGGAGG |
| Type 23 | CTTAAGGAGGAGGAAGAAGAC<u>TGCGT</u>GAGGAGGAGGAGGCAGAGGAC |
| Type 24 | CTTAAGGAGGAGGAAGAAGACCAGGAGGCAGAGGACAAGGAGG |
| Type 25 | TAAGGAGGAGGAAGAAGACA<u>AA</u>AGGCAGAGGACAAGGAGGATG |
| Type 26 | TAAGGAGGAGGAAGAAGACAAAAACGCAAAGAGGAGGAGGAG |
| Type 27 | AAGGAGGAGGAAGAAGACAAG<u>TGTTT</u>CGCAAAGAGGAGGAGGAGGCA |
| Type 28 | GGAAGAAGACAAGAAACGCAAAAGGAGGATGATGAGGACAAA |
| Type 29 | GAAGACAAGAAACGCAAAGAG<u>CCTCCTCTTTGTCT</u>AAGGAGGATGATGAGGACAAA |
| Type 30 | AGACAAGAAACGCAAAGAGGA<u>CCATCCTTGTC</u>GGAGGATGATGAGGACAAAGA |
| Type 31 | AGAGGAGGAGGAGGCAGAGG*G*CAA<u>TTGTC</u>GGAGGATGATGAGGACAAAG |
| Type 32 | GAGGAGGAGGAGGCAGAGGAC<u>TGTC</u>GGAGGATGATGAGGACAAAGA |
| Type 33 | GAGGAGGAGGCAGAGGACAA<u>ATGTC</u>GGAGGATGATGAGGACAAAG |
| Type 34 | AGGAGGAGGAGGCAGAGGACACTTGTCGGAGGATGATGAGGACAAAGA |

TABLE 7-continued

Sequences of mutation junctions in the cDNA sequence
of CALR for the design of mutation specific probes
or PCR primers. Table 7 discloses SEQ ID NOS 440-475,
respectively, in order of appearance.

| CALR mutation positions | cDNA junction sequences in mutated |
| --- | --- |
| Type 35 | AGGAGGAGGAGGCAGAGGACATTTGTCGGAGGATGATGAGGACAAAGA |
| Type 36 | AGGAGGAGGCAGAGGACAAGTGTCGGAGGATGATGAGGACAAAGA |

Bold letters indicate the borders of a deletion event; underlined letters indicate inserted sequences; Bold and italic letters indicate single nucleotide variants Myeloid cell specific somatic mutations in the CALR gene were identified in patients with MPN. The mutations strongly associate with those patients that are negative for both JAK2 and MPL mutations (the previously described disease causing mutations in MPN). As CALR mutations are found in 88% of PMF cases, and in 67% of ET cases double negative for JAK2 and MPL, it is believed that CALR mutations are filling in a large diagnostic gap for JAK2/MPL negative ET and PMF. Therefore, detection of CALR mutations at the level of genomic DNA, RNA or cDNA offers an important diagnostic test for MPN.

All identified mutations of CALR are in last exon 9 encoding the C-terminal amino acids of the protein and are predominantly insertion/deletion mutations. The vast majority of mutations were present in a heterozygous state and they cause a frameshift to the same alternative reading frame. This frameshift results in the replacement of the C-terminal negatively charged amino acids (aspartic and glutamic acid rich) of calreticulin by a predominantly positively charged polypeptide rich in arginine and methionine. In addition, the last 4 amino acids of calreticulin (KDEL (SEQ ID NO: 1331)) contain the endoplasmatic reticulum retention signal. This signal is absent in the mutant calreticulin suggesting that the mutant protein is less represented in the ER compared to the wild type protein. As the negatively charged C-terminus of calreticulin is the low affinity high capacity Ca2+ binding domain, it is believed that the Ca2+ binding function of the mutant protein is lost.

Figure 3D:
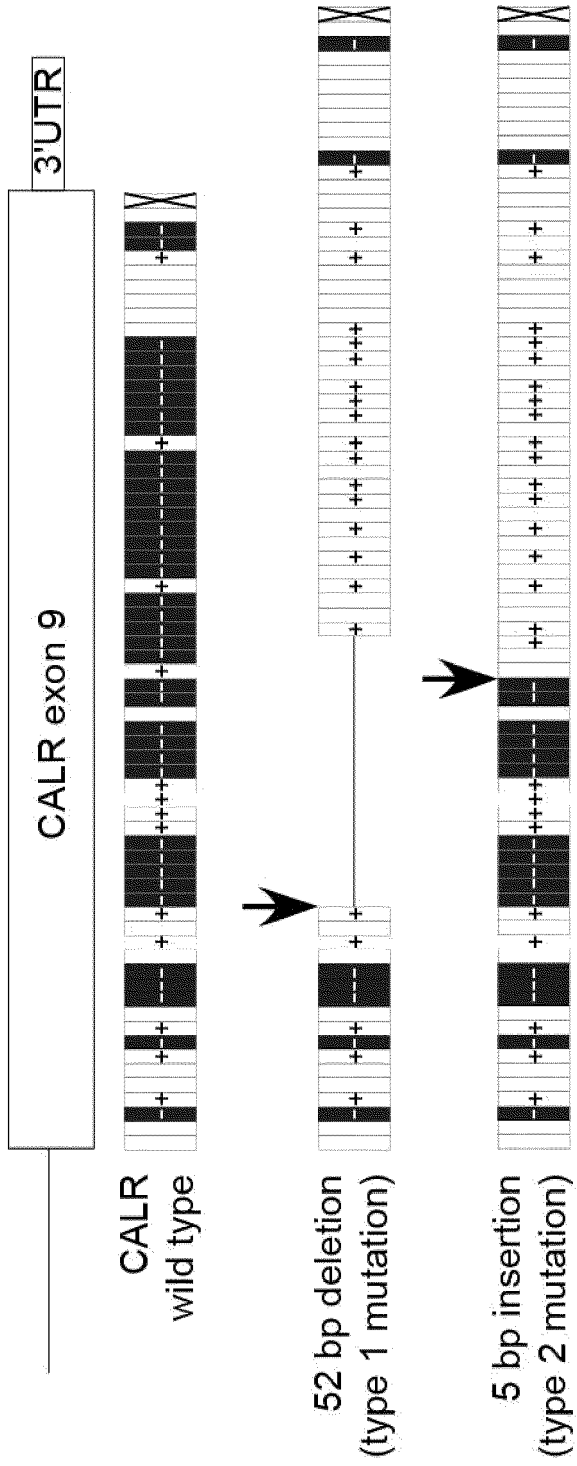
Figure 3E:
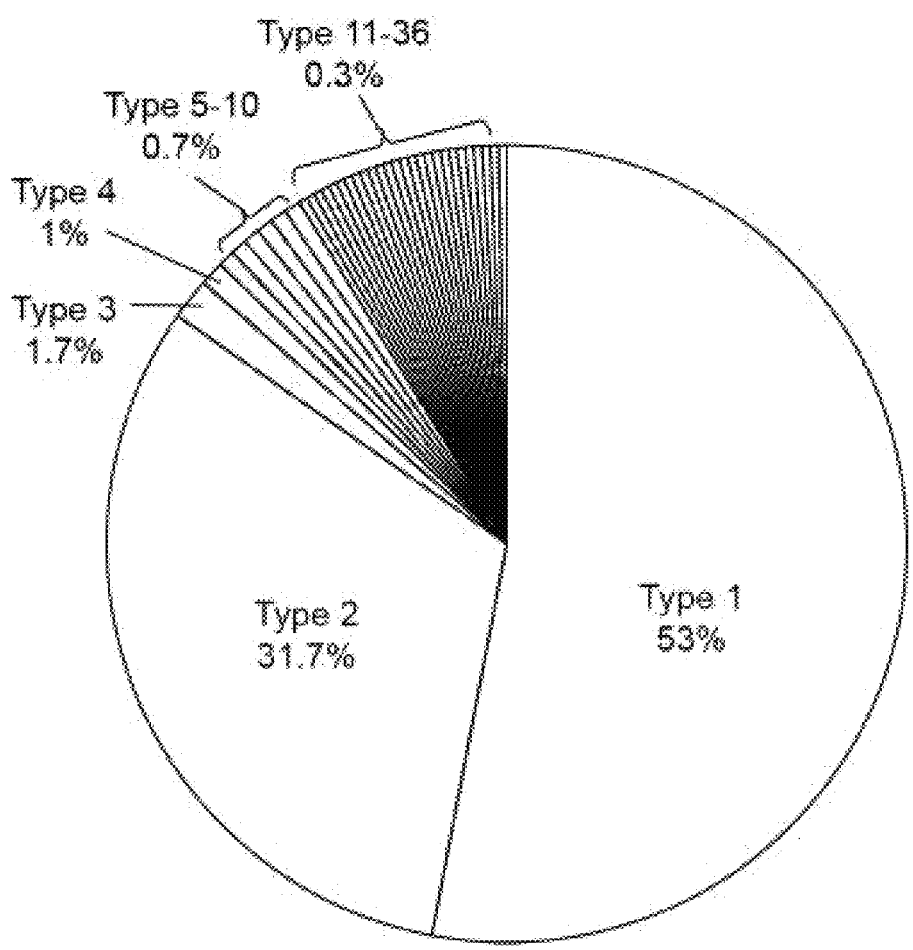

From all CALR mutated cases, mutations of type 1 (52 base pair deletion) and type 2 (5 base pair insertion) were representing 53% and 32%, respectively (FIG. 3D,E). The other mutation types were observed at much lower frequencies, many detected only in a single patient (FIG. 3E). As all 36 mutation types frameshift to alternative reading frame 1, the resulting mutant CALR proteins share a common novel amino acid sequence at the C-terminus (TABLE 6). The C-terminal peptide derived from alternative reading frame 1 contains a number of positively charged amino acids, whereas the wild type CALR C-terminus is largely negatively charged (FIG. 3B). In addition, the wild type calreticulin contains the endoplasmic reticulum retention motif at the C-terminal end (KDEL amino acid sequence (SEQ ID NO: 1331)). The C-terminal KDEL (SEQ ID NO: 1331) end is lost in all mutant variants (TABLE 6). Depending on the type of mutation, the mutant proteins retain variable amounts of the negatively charged amino acids of wild type calreticulin. The 52 base pair deletions of type 1 eliminate almost all negatively charged amino acids, whereas the 5 base pair insertions of type 2 retain approximately half of negatively charged amino acids (FIG. 3D). Given these differences, we hypothesized that type 1 and type 2 mutations may be associated with qualitatively different phenotypes. Accordingly, we found that the type 1 deletions were significantly more frequent in primary myelofibrosis compared to essential thrombocythemia (P=0.0007). In addition, we detected only 3 patients homozygous for CALR mutations associated with uniparental disomy of chromosome 19p and all 3 cases had a 5 base pair insertion of type 2 (FIG. 4A).

CALR Mutations are Acquired Early in the Clonal Evolution and Mutant Clones are Stable In order to investigate whether mutations in CALR are acquired early or late in the clonal history of a patient, we analyzed hematopoietic progenitor colonies from two patients for which we had mutational profiles from whole exome sequencing. The clonal hierarchies of patients H_0191 and H_0296 are shown in FIG. 4B. We conclude that mutations in CALR were acquired early in the major clones of the two patients analyzed.

For 24 patients with mutant CALR we had follow-up samples available, all of which tested positive for the mutation.

Clinical Significance of CALR Mutations

Figure 6A:
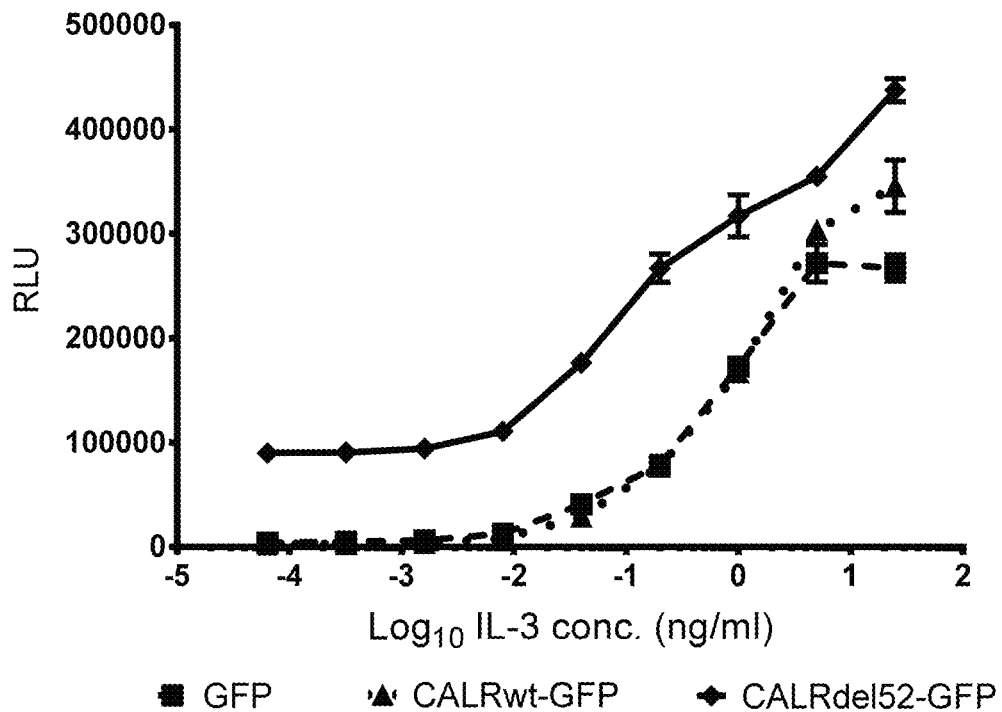
Figure 6B:
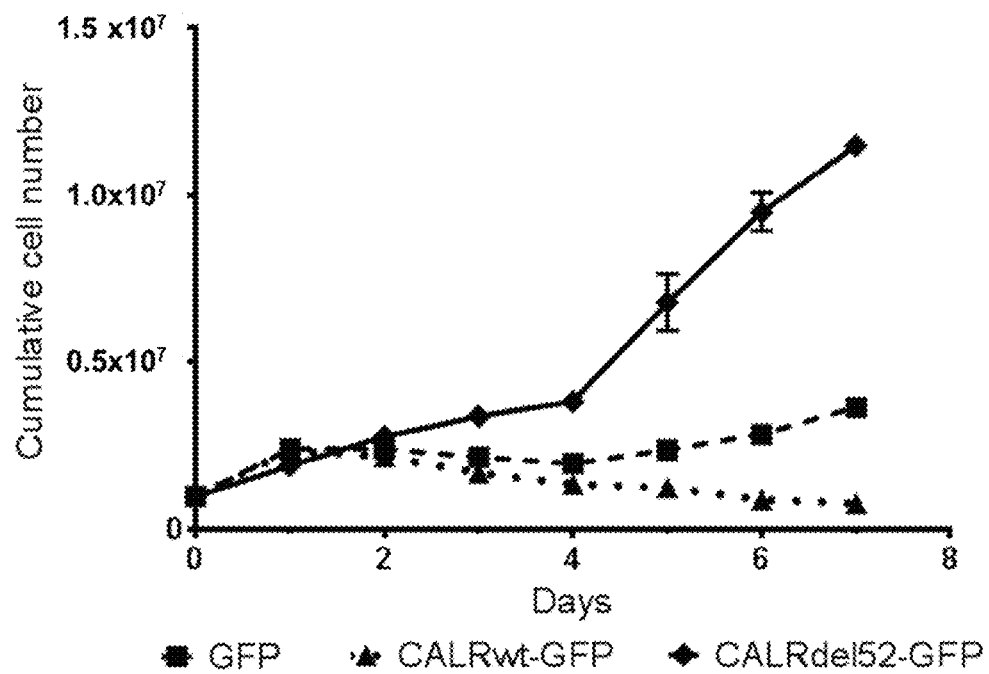
Figure 6C:
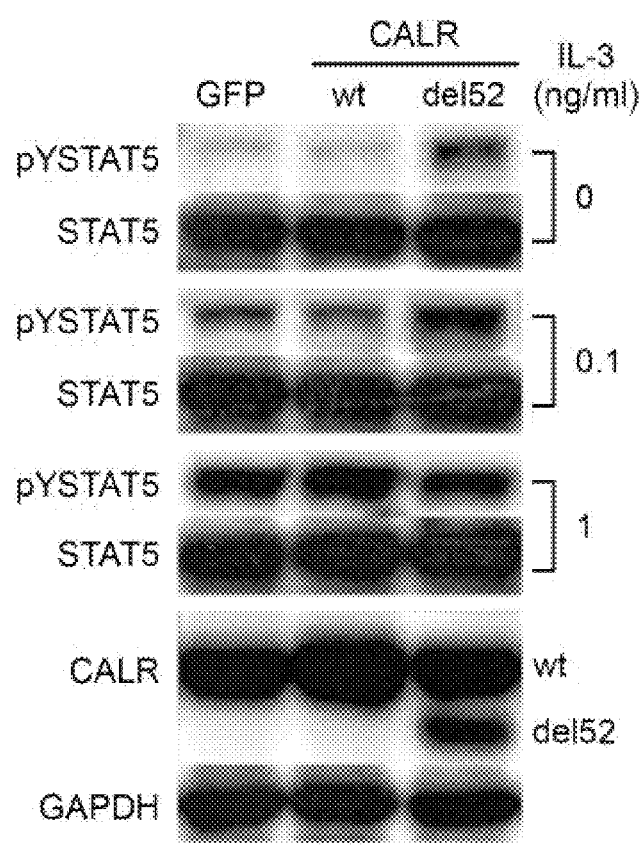

Overall we studied 1215 patients with essential thrombocythemia or primary myelofibrosis TABLE 8. Of those, 63.4% carried JAK2-V617F, 4.4% carried activating mutations of MPL exon 10, 23.5% carried mutations of CALR exon 9, and only 8.8% had none of the previous clonal markers. Of note, most of these latter patients clustered in the essential thrombocythemia subgroup. We used the Wilcoxon rank-sum test to compare hematologic values in patients carrying different mutant genes. Within patients with essential thrombocythemia, those carrying CALR mutation had lower hemoglobin level, lower white blood cell count, and higher platelet count at diagnosis compared with patients carrying mutant JAK2 (P<0.001 in all instances). Within patients with primary myelofibrosis, those carrying a CALR mutation had a lower white blood cell count (P=0.027) and a higher platelet count (P<0.001) than patients with mutant JAK2. Overall survival and risk of thrombosis were analyzed only in patients carrying a mutation in JAK2, MPL, or CALR, i.e., having a clonal marker. Assuming that mutation status did not change with time, we did all analyses since initial diagnosis. Since 6 patients were excluded due to inadequate follow-up, a total of 1102 patients were examined. The median follow-up for the whole cohort of patients with any of the three genes mutated was 5.7 years (range 0-31 years). As shown in FIG. 5A, there was a significant difference in overall survival between the 3 subgroups of patients with primary myelofibrosis (P<0.001). Those carrying a somatic mutation of CALR had a better overall survival than those with JAK2 (P<0.001) or MPL mutation (P<0.001), while no difference was observed between the latter two subgroups. In patients with essential thrombocythemia, who have much longer overall survivals, there was a significant difference only between CALR mutated and JAK2 mutated patients (P=0.043, FIG. 5B). In a Cox regression multivariate analysis of overall survival including type of myeloid neoplasm (essential thrombocythemia versus primary myelofibrosis), type of mutant gene, and patient cohort (Pavia versus Vienna) as covariates, the first two factors were found to be independent prognostic factors. As expected, primary myelofibrosis was associated with shorter overall survival as compared with essential thrombocythemia (hazard ratio of death 7.1, P<0.001, CI 4.9-10.2). In addition, the type of mutant gene had an independent effect on survival. In fact, as compared with patients carrying a CALR mutation, both those with JAK2 (hazard ratio 3.1, P<0.001, CI 2.0-4.7) and those carrying an MPL mutation (hazard ratio 3.5, P<0.001, CI 1.8-6.7) had a higher risk of death. The cumulative incidence of thrombosis in essential thrombocythemia was calculated with a competing risk approach with death from all causes as a competing event, and is reported in TABLE 9 while the actual curves are shown in FIG. 5C. Patients with essential thrombocythemia carrying a CALR mutation had a lower risk of thrombosis than patients carrying a JAK2 mutation (P=0.003), while no significant difference was found between the other subgroups. It should be noted that the subgroup of patients carrying an MPL mutation was small.

tion of JAK-STAT signaling, we determined the sensitivity of cells to the JAK2 kinase inhibitor SAR302503. As shown in FIG. 7 both wild type and the 52 base pair deletion mutant of CALR showed similar sensitivity to SAR302503 suggesting that the interleukin-3-independent growth of the mutant CALR cells is dependent on JAK2 or a JAK family kinase targeted by SAR302503. To confirm this hypothesis, we examined the phosphorylation of STAT5 in the presence and absence of interleukin-3 in the control and CALR transfected cell lines. We detected increased phosphorylation of STAT5 in the absence of interleukin-3 in the 52 base pair deletion mutant of CALR and at 0.1 ng/ml interleukin-3 concentration (FIG. 6C). Thus, increased activation of JAK-STAT signaling is likely responsible for the cytokine-independent growth of cells expressing the 52 base pair deletion mutant of CALR.

Figure 6D:
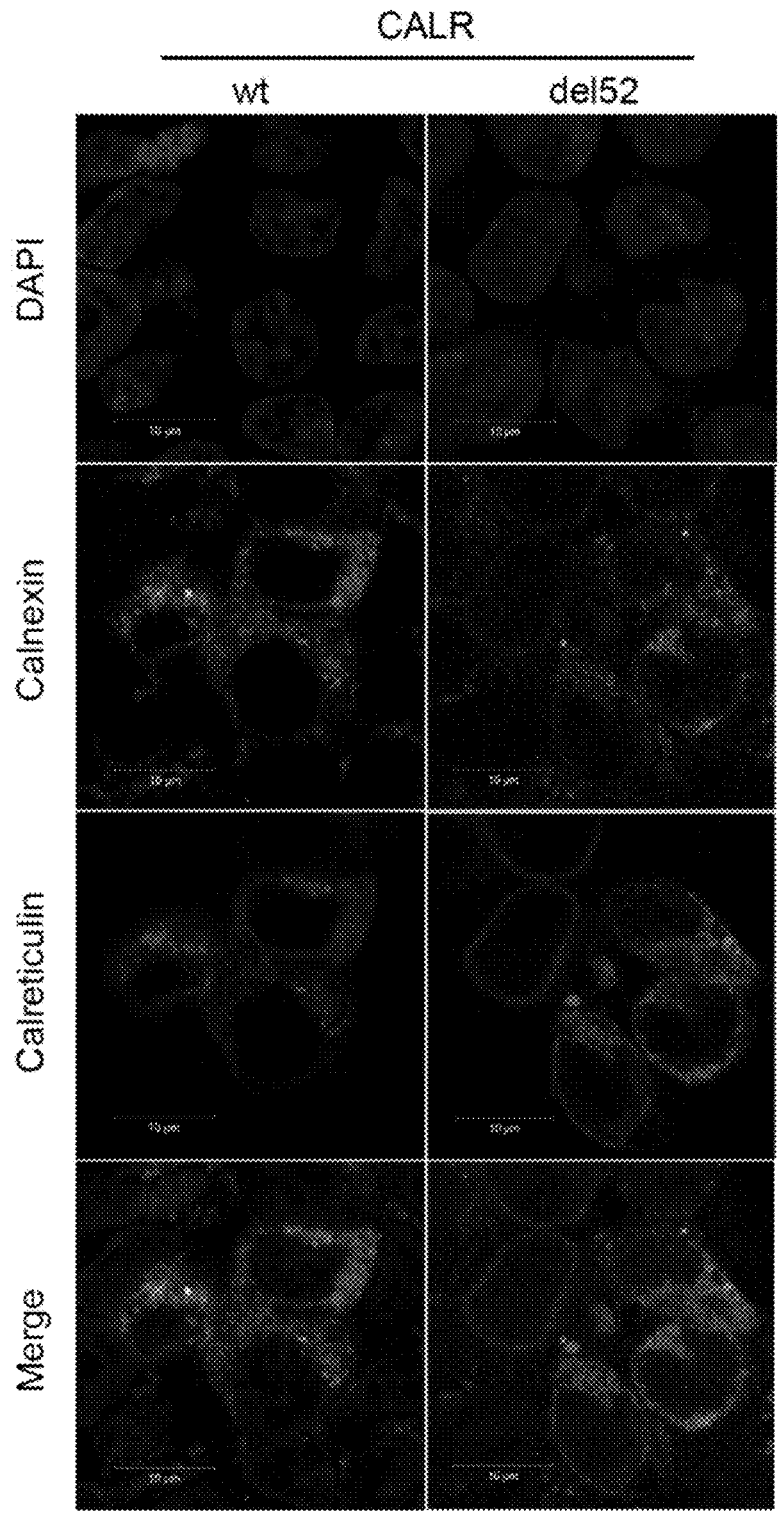

Immunofluorescence microscopy was used to determine the localization of wild type and type 1 mutant CALR. Upon overexpression in HEK cells, the wild type CALR colocalized with the endoplasmic reticulum (stained with calnexin). In case of the type 1 mutant CALR, this colocalization was less prominent most likely due to the absence of the KDEL sequence (SEQ ID NO: 1331) from the C-terminus of the mutant CALR (FIG. 6D).

TABLE 8

Cohort descriptives for the 1215 patients used to estimate clinical significance of CALR mutations

| Diagnosis | JAK2 mutated (n = 770) | MPL exon 10 mutated (n = 53) | CALR mutated (n = 285) | JAK2/MPL/CALR wild type (n = 107) | All patients (n = 1215) |
|---|---|---|---|---|---|
| Essential thrombocythemia | 581 (65%) | 35 (3.9%) | 186 (20.8%) | 92 (10.3%) | 894 |
| Primary myelofibrosis | 189 (58.9%) | 18 (5.6%) | 99 (30.8%) | 15 (4.7%) | 321 |

TABLE 9

Cumulative incidence of thrombosis comparing patients with mutant JAK2, MPL and CALR

| Cumulative incidence of thrombosis | At 5 years | At 10 years | At 15 years |
|---|---|---|---|
| JAK2-mutated | 13% (CI 10-16.4) | 21% (CI 16.6-25.7) | 27.1% (CI 21.4-33) |
| MPL-mutated | 9.3% (CI 2.3-22.3) | 9.3% (CI 2.3-22.3) | 17.6% (CI 4.4-38.1) |
| CALR-mutated | 6.3% (CI 3.2-10.8) | 11% (CI 6.3-17.1) | 12.8% (CI 7.3-20) |

Functional Analysis of the Type 1 CALR Mutation

In order to study the functional effects of mutant CALR we cloned the cDNA of the wild type CALR and the type 1 mutation (52 base pair deletion) into the retroviral expression vector pMSCV-IRES-GFP. After retroviral production and transfection of the CALR cDNAs into the interleukin-3-dependent murine cell line Ba/F3 we sorted the transgene positive cells by flow cytometry for GFP. Next we measured interleukin-3-dependent proliferation of cells. Cells expressing the type 1 CALR mutation exhibited interleukin-3-independent growth and hypersensitivity to interleukin-3 (FIG. 6A). When we measured the proliferation of cells in the absence of interleukin-3, only the CALR 52 base pair deletion mutation exhibited significant accumulation of cells (FIG. 6B). To investigate if the interleukin-3-independence in the CALR 52 base pair deletion mutant cells is caused by activa- We have identified somatic mutations in the CALR gene in patients with primary myelofibrosis and essential thrombocythemia. CALR mutations are mutually exclusive with mutations in both JAK2 and MPL. No CALR mutations were found in polycythemia vera, a myeloproliferative neoplasm that is specifically associated with JAK2 mutations. CALR mutations are the second most frequent mutation after JAK2 in myeloproliferative neoplasms. We have also studied patients with other myeloid neoplasms, and found CALR mutations only in 12.5% of cases with refractory anemia with ring sideroblasts associated with marked thrombocytosis, a typical myelodysplastic/myeloproliferative neoplasm (Malcovati et al, 2009) This strongly supports a causal relationship between CALR mutations and excessive platelet production.

As CALR mutations are found in about 73% of patients that do not carry alterations of JAK2 and MPL, we believe they are filling in the current molecular diagnostic gap in myeloproliferative neoplasms. Altogether, only less than 10% of our patients with essential thrombocythemia or primary myelofibrosis do not carry a somatic mutation of JAK2, MPL or CALR. In some of these subjects, the mutated clone might be too small to be detected with the current approaches. Rare mutant driver genes may play a role in other patients, while some patients might not have a clonal disease at all. This is particularly true for patients with a clinical diagnosis of essential thrombocythemia, as differential diagnosis between clonal and reactive thrombocytosis may be difficult without a clonal marker (Schafer, 2004). Overall, the assessment of CALR mutations markedly improves the current diagnostic approach for essential thrombocythemia or primary myelofibrosis, and should be included in the WHO criteria for these disorders (Sverdlow et al, 2008)

All the mutations of CALR we identified are insertion/deletion mutations in the last exon encoding the C-terminal amino acids of the protein. The most mutations are present in a heterozygous state and cause a frameshift to a specific alternative reading frame. This frameshift results in the replacement of the C-terminal negatively charged amino acids of calreticulin by a positively charged polypeptide rich in arginine and methionine. The last 4 amino acids of calreticulin (KDEL(SEQ ID NO: 1331)) contain the endoplasmic reticulum retention signal. This signal is absent in the mutant calreticulin. Consequently mutant calreticulin has an altered subcellular localization. As the negatively charged C-terminus of calreticulin is the low-affinity high-capacity Ca2+ binding domain, the Ca2+ binding function of the mutant protein may be impaired. The presence of the peptide sequence derived from the alternative reading frame at the C-terminus of mutated CALR offers an opportunity for immunologic targeting as it represents a cancer specific epitope.

To further analyze the oncogenic capability of the mutant calreticulin, we generated Ba/F3 cells with overexpression of the wild type and the type 1 mutant CALR (52 base pair deletion—del52). Interestingly, the CALR del52 Ba/F3 cells showed cytokine independent proliferation. However, the growth of Ba/F3 cells expressing wild type and mutant calreticulin was suppressed equally upon treatment with a JAK2 kinase inhibitor, suggesting the requirement of the JAK-STAT pathway in the mutant calreticulin-induced cytokine independence. In accordance, we could detect increased phosphorylation of STAT5 in del52 Ba/F3 cells, both in the absence and presence of interleukin-3 stimulation. Calreticulin/Ca2+/calmodulin has been previously shown to modulate the activity of Stats. Calreticulin complex with ERp57, in endoplasmic reticulum, suppresses the phosphorylation and transcriptional activity of Stat3 in mouse embryonic fibroblasts (Coe et al, 2010). Moreover, inhibition of the Ca2+/calmodulin dependent kinase II gamma results in reduced levels of phosphorylated Stat1, Stat3 and Stat5 (Si & Collins 2008). Interestingly, overexpression of calreticulin attenuates interferon alpha induced Stat1 phosphorylation, resulting in interferon resistance (Yue et al, 2012). Further studies are required to elucidate the mechanism of the activation of JAK-STAT pathway by the mutant calreticulin in myeloid cells. The involvement of the JAK-STAT signaling pathway in CALR positive patients may also explain the affectivity of JAK2 inhibitor therapy in primary myelofibrosis. However, our results indicate that the JAK2 inhibitors may not be selective for cells expressing the mutated CALR compared to the CALR wild type cells.

Although our analyses of clinical outcome are retrospective, they strongly suggest that CALR positive myeloproliferative neoplasms have a more benign clinical course than the corresponding disorders associated with JAK2 or MPL mutation. Due to the small number of MPL mutated patients, the more reliable comparisons are those between JAK2 mutated and CALR mutated patients. Our observations clearly show that CALR mutated patients have lower risk of thrombosis and better overall survival than JAK2 mutated patients. The lower incidence of thromboembolic complications might be related to the fact that CALR mutated patients had lower hemoglobin levels and lower white blood cell counts. A better overall survival was observed both in patients with primary myelofibrosis and those with essential thrombocythemia, although it was much more relevant in the former, confirming previous findings on patients with and without JAK2 mutations (Campbell et al, 2006b; Rumi et al, 2013). From a practical point of view, the different impact of mutant genes might be incorporated in existing prognostic scoring systems for primary myelofibrosis and essential thrombocythemia (Passamonti 2010b, Passamonti 2012) and may also guide therapeutic decision-making. More specifically, CALR molecular characterization should become an essential component of future clinical management of essential thrombocythemia and primary myelofibrosis.

Nucleotide and Amino Acid Sequences

The present invention refers to the following nucleotide and amino acid sequences:

The sequences provided herein are in part available in the NCBI database and can be retrieved from www[dot]ncbi[dot]nlm[dot]nih[dot]gov/sites/entrez?db=gene; The sequences also relate to annotated and modified sequences. The present invention also provides techniques and methods wherein homologous sequences, and variants of the concise sequences provided herein are used. Preferably, such "variants" are genetic variants.

SEQ ID No. 1: Nucleotide sequence encoding the C-terminus of *homo sapiens* calreticulin mutant type 18
SEQ ID No. 2: Nucleotide sequence encoding the C-terminus of *homo sapiens* calreticulin mutant type 18
SEQ ID No. 3: Nucleotide sequence encoding the C-terminus of *homo sapiens* calreticulin mutant type 18
SEQ ID No. 4: Amino acid sequence of the C-terminus of *homo sapiens* calreticulin mutant type 18
SEQ ID No. 5: Nucleotide sequence encoding the C-terminus of *homo sapiens* calreticulin mutant type 1
SEQ ID No. 6: Nucleotide sequence encoding the C-terminus of *homo sapiens* calreticulin mutant type 1
SEQ ID No. 7: Nucleotide sequence encoding the C-terminus of *homo sapiens* calreticulin mutant type 1
SEQ ID No. 8: Amino acid sequence of the C-terminus of *homo sapiens* calreticulin mutant type 1
SEQ ID No. 9: Nucleotide sequence encoding the C-terminus of *homo sapiens* calreticulin mutant type 2
SEQ ID No. 10: Nucleotide sequence encoding the C-terminus of *homo sapiens* calreticulin mutant type 2
SEQ ID No. 11 Nucleotide sequence encoding the C-terminus of *homo sapiens* calreticulin mutant type 2
SEQ ID No. 12 Amino acid sequence of the C-terminus of *homo sapiens* calreticulin mutant type 2
SEQ ID No. 13 Nucleotide sequence encoding the C-terminus of *homo sapiens* calreticulin mutant type 3
SEQ ID No. 14 Nucleotide sequence encoding the C-terminus of *homo sapiens* calreticulin mutant type 3
SEQ ID No. 15 Nucleotide sequence encoding the C-terminus of *homo sapiens* calreticulin mutant type 3
SEQ ID No. 16 Amino acid sequence of the C-terminus of *homo sapiens* calreticulin mutant type 3
SEQ ID No. 17 Nucleotide sequence encoding the C-terminus of *homo sapiens* calreticulin mutant type 4
SEQ ID No. 18 Nucleotide sequence encoding the C-terminus of *homo sapiens* calreticulin mutant type 4
SEQ ID No. 19 Nucleotide sequence encoding the C-terminus of *homo sapiens* calreticulin mutant type 4
SEQ ID No. 20 Amino acid sequence of the C-terminus of *homo sapiens* calreticulin mutant type 4
SEQ ID No. 21 Nucleotide sequence encoding the C-terminus of *homo sapiens* calreticulin mutant type 5
SEQ ID No. 22 Nucleotide sequence encoding the C-terminus of *homo sapiens* calreticulin mutant type 5
SEQ ID No. 23 Nucleotide sequence encoding the C-terminus of *homo sapiens* calreticulin mutant type 5

SEQ ID No. 24 Amino acid sequence of the C-terminus of *homo sapiens* calreticulin mutant type 5
SEQ ID No. 25 Nucleotide sequence encoding the C-terminus of *homo sapiens* calreticulin mutant type 6
SEQ ID No. 26 Nucleotide sequence encoding the C-terminus of *homo sapiens* calreticulin mutant type 6
SEQ ID No. 27 Nucleotide sequence encoding the C-terminus of *homo sapiens* calreticulin mutant type 6
SEQ ID No. 28 Amino acid sequence of the C-terminus of *homo sapiens* calreticulin mutant type 6
SEQ ID No. 29 Nucleotide sequence encoding the C-terminus of *homo sapiens* calreticulin mutant type 7
SEQ ID No. 30 Nucleotide sequence encoding the C-terminus of *homo sapiens* calreticulin mutant type 7
SEQ ID No. 31 Nucleotide sequence encoding the C-terminus of *homo sapiens* calreticulin mutant type 7
SEQ ID No. 32 Amino acid sequence of the C-terminus of *homo sapiens* calreticulin mutant type 7
SEQ ID No. 33 Nucleotide sequence encoding the C-terminus of *homo sapiens* calreticulin mutant type 8
SEQ ID No. 34 Nucleotide sequence encoding the C-terminus of *homo sapiens* calreticulin mutant type 8
SEQ ID No. 35 Nucleotide sequence encoding the C-terminus of *homo sapiens* calreticulin mutant type 8
SEQ ID No. 36 Amino acid sequence of the C-terminus of *homo sapiens* calreticulin mutant type 8
SEQ ID No. 37 Nucleotide sequence encoding the C-terminus of *homo sapiens* calreticulin mutant type 9
SEQ ID No. 38 Nucleotide sequence encoding the C-terminus of *homo sapiens* calreticulin mutant type 9
SEQ ID No. 39 Nucleotide sequence encoding the C-terminus of *homo sapiens* calreticulin mutant type 9
SEQ ID No. 40 Amino acid sequence of the C-terminus of *homo sapiens* calreticulin mutant type 9
SEQ ID No. 41 Nucleotide sequence encoding the C-terminus of *homo sapiens* calreticulin mutant type 10
SEQ ID No. 42 Nucleotide sequence encoding the C-terminus of *homo sapiens* calreticulin mutant type 10
SEQ ID No. 43 Nucleotide sequence encoding the C-terminus of *homo sapiens* calreticulin mutant type 10
SEQ ID No. 44 Amino acid sequence of the C-terminus of *homo sapiens* calreticulin mutant type 10
SEQ ID No. 45 Nucleotide sequence encoding the C-terminus of *homo sapiens* calreticulin mutant type 11
SEQ ID No. 46 Nucleotide sequence encoding the C-terminus of *homo sapiens* calreticulin mutant type 11
SEQ ID No. 47 Nucleotide sequence encoding the C-terminus of *homo sapiens* calreticulin mutant type 11
SEQ ID No. 48 Amino acid sequence of the C-terminus of *homo sapiens* calreticulin mutant type 11
SEQ ID No.49 Nucleotide sequence encoding the C-terminus of *homo sapiens* calreticulin mutant type 12
SEQ ID No.50 Nucleotide sequence encoding the C-terminus of *homo sapiens* calreticulin mutant type 12
SEQ ID No.51 Nucleotide sequence encoding the C-terminus of *homo sapiens* calreticulin mutant type 12
SEQ ID No.52 Amino acid sequence of the C-terminus of *homo sapiens* calreticulin mutant type 12
SEQ ID No.53 Nucleotide sequence encoding the C-terminus of *homo sapiens* calreticulin mutant type 13
SEQ ID No.54 Nucleotide sequence encoding the C-terminus of *homo sapiens* calreticulin mutant type 13
SEQ ID No.55 Nucleotide sequence encoding the C-terminus of *homo sapiens* calreticulin mutant type 13
SEQ ID No.56 Amino acid sequence of the C-terminus of *homo sapiens* calreticulin mutant type 13
SEQ ID No.57 Nucleotide sequence encoding the C-terminus of *homo sapiens* calreticulin mutant type 14
SEQ ID No.58 Nucleotide sequence encoding the C-terminus of *homo sapiens* calreticulin mutant type 14
SEQ ID No.59 Nucleotide sequence encoding the C-terminus of *homo sapiens* calreticulin mutant type 14
SEQ ID No.60 Amino acid sequence of the C-terminus of *homo sapiens* calreticulin mutant type 14
SEQ ID No.61 Nucleotide sequence encoding the C-terminus of *homo sapiens* calreticulin mutant type 15
SEQ ID No.62 Nucleotide sequence encoding the C-terminus of *homo sapiens* calreticulin mutant type 15
SEQ ID No.63 Nucleotide sequence encoding the C-terminus of *homo sapiens* calreticulin mutant type 15
SEQ ID No.64 Amino acid sequence of the C-terminus of *homo sapiens* calreticulin mutant type 15
SEQ ID No.65 Nucleotide sequence encoding the C-terminus of *homo sapiens* calreticulin mutant type 16
SEQ ID No.66 Nucleotide sequence encoding the C-terminus of *homo sapiens* calreticulin mutant type 16
SEQ ID No.67 Nucleotide sequence encoding the C-terminus of *homo sapiens* calreticulin mutant type 16
SEQ ID No.68 Amino acid sequence of the C-terminus of *homo sapiens* calreticulin mutant type 16
SEQ ID No.69 Nucleotide sequence encoding the C-terminus of *homo sapiens* calreticulin mutant type 17
SEQ ID No.70 Nucleotide sequence encoding the C-terminus of *homo sapiens* calreticulin mutant type 17
SEQ ID No.71 Nucleotide sequence encoding the C-terminus of *homo sapiens* calreticulin mutant type 17
SEQ ID No.72 Amino acid sequence of the C-terminus of *homo sapiens* calreticulin mutant type 17
SEQ ID No.73 Nucleotide sequence encoding the C-terminus of *homo sapiens* calreticulin mutant type 19
SEQ ID No.74 Nucleotide sequence encoding the C-terminus of *homo sapiens* calreticulin mutant type 19
SEQ ID No.75 Nucleotide sequence encoding the C-terminus of *homo sapiens* calreticulin mutant type 19
SEQ ID No.76 Amino acid sequence of the C-terminus of *homo sapiens* calreticulin mutant type 19
SEQ ID No.77 Nucleotide sequence encoding the C-terminus of *homo sapiens* calreticulin mutant type 20
SEQ ID No.78 Nucleotide sequence encoding the C-terminus of *homo sapiens* calreticulin mutant type 20
SEQ ID No.79 Nucleotide sequence encoding the C-terminus of *homo sapiens* calreticulin mutant type 20
SEQ ID No.80 Amino acid sequence of the C-terminus of *homo sapiens* calreticulin mutant type 20
SEQ ID No.81 Nucleotide sequence encoding the C-terminus of *homo sapiens* calreticulin mutant type 21
SEQ ID No.82 Nucleotide sequence encoding the C-terminus of *homo sapiens* calreticulin mutant type 21
SEQ ID No.83 Nucleotide sequence encoding the C-terminus of *homo sapiens* calreticulin mutant type 21
SEQ ID No.84 Amino acid sequence of the C-terminus of *homo sapiens* calreticulin mutant type 21
SEQ ID No.85 Nucleotide sequence encoding the C-terminus of *homo sapiens* calreticulin mutant type 22
SEQ ID No.86 Nucleotide sequence encoding the C-terminus of *homo sapiens* calreticulin mutant type 22
SEQ ID No.87 Nucleotide sequence encoding the C-terminus of *homo sapiens* calreticulin mutant type 22

SEQ ID No.88 Amino acid sequence of the C-terminus of *homo sapiens* calreticulin mutant type 22
SEQ ID No.89 Nucleotide sequence encoding the C-terminus of *homo sapiens* calreticulin mutant type 23
SEQ ID No.90 Nucleotide sequence encoding the C-terminus of *homo sapiens* calreticulin mutant type 23
SEQ ID No.91 Nucleotide sequence encoding the C-terminus of *homo sapiens* calreticulin mutant type 23
SEQ ID No.92 Amino acid sequence of the C-terminus of *homo sapiens* calreticulin mutant type 23
SEQ ID No.93 Nucleotide sequence encoding the C-terminus of *homo sapiens* calreticulin mutant type 24
SEQ ID No.94 Nucleotide sequence encoding the C-terminus of *homo sapiens* calreticulin mutant type 24
SEQ ID No.95 Nucleotide sequence encoding the C-terminus of *homo sapiens* calreticulin mutant type 24
SEQ ID No.96 Amino acid sequence of the C-terminus of *homo sapiens* calreticulin mutant type 24
SEQ ID No.97 Nucleotide sequence encoding the C-terminus of *homo sapiens* calreticulin mutant type 25
SEQ ID No.98 Nucleotide sequence encoding the C-terminus of *homo sapiens* calreticulin mutant type 25
SEQ ID No.99 Nucleotide sequence encoding the C-terminus of *homo sapiens* calreticulin mutant type 25
SEQ ID No.100 Amino acid sequence of the C-terminus of *homo sapiens* calreticulin mutant type 25
SEQ ID No.101 Nucleotide sequence encoding the C-terminus of *homo sapiens* calreticulin mutant type 26
SEQ ID No.102 Nucleotide sequence encoding the C-terminus of *homo sapiens* calreticulin mutant type 26
SEQ ID No.103 Nucleotide sequence encoding the C-terminus of *homo sapiens* calreticulin mutant type 26
SEQ ID No.104 Amino acid sequence of the C-terminus of *homo sapiens* calreticulin mutant type 26
SEQ ID No.105 Nucleotide sequence encoding the C-terminus of *homo sapiens* calreticulin mutant type 27
SEQ ID No.106 Nucleotide sequence encoding the C-terminus of *homo sapiens* calreticulin mutant type 27
SEQ ID No.107 Nucleotide sequence encoding the C-terminus of *homo sapiens* calreticulin mutant type 27
SEQ ID No.108 Amino acid sequence of the C-terminus of *homo sapiens* calreticulin mutant type 27
SEQ ID No.109 Nucleotide sequence encoding the C-terminus of *homo sapiens* calreticulin mutant type 28
SEQ ID No.110 Nucleotide sequence encoding the C-terminus of *homo sapiens* calreticulin mutant type 28
SEQ ID No.111 Nucleotide sequence encoding the C-terminus of *homo sapiens* calreticulin mutant type 28
SEQ ID No.112 Amino acid sequence of the C-terminus of *homo sapiens* calreticulin mutant type 28
SEQ ID No.113 Nucleotide sequence encoding the C-terminus of *homo sapiens* calreticulin mutant type 29
SEQ ID No.114 Nucleotide sequence encoding the C-terminus of *homo sapiens* calreticulin mutant type 29
SEQ ID No.115 Nucleotide sequence encoding the C-terminus of *homo sapiens* calreticulin mutant type 29
SEQ ID No.116 Amino acid sequence of the C-terminus of *homo sapiens* calreticulin mutant type 29
SEQ ID No.117 Nucleotide sequence encoding the C-terminus of *homo sapiens* calreticulin mutant type 30
SEQ ID No.118 Nucleotide sequence encoding the C-terminus of *homo sapiens* calreticulin mutant type 30
SEQ ID No.119 Nucleotide sequence encoding the C-terminus of *homo sapiens* calreticulin mutant type 30
SEQ ID No.120 Amino acid sequence of the C-terminus of *homo sapiens* calreticulin mutant type 30
SEQ ID No.121 Nucleotide sequence encoding the C-terminus of *homo sapiens* calreticulin mutant type 31
SEQ ID No.122 Nucleotide sequence encoding the C-terminus of *homo sapiens* calreticulin mutant type 31
SEQ ID No.123 Nucleotide sequence encoding the C-terminus of *homo sapiens* calreticulin mutant type 31
SEQ ID No.124 Amino acid sequence of the C-terminus of *homo sapiens* calreticulin mutant type 31
SEQ ID No.125 Nucleotide sequence encoding the C-terminus of *homo sapiens* calreticulin mutant type 32
SEQ ID No.126 Nucleotide sequence encoding the C-terminus of *homo sapiens* calreticulin mutant type 32
SEQ ID No.127 Nucleotide sequence encoding the C-terminus of *homo sapiens* calreticulin mutant type 32
SEQ ID No.128 Amino acid sequence of the C-terminus of *homo sapiens* calreticulin mutant type 32
SEQ ID No.129 Nucleotide sequence encoding the C-terminus of *homo sapiens* calreticulin mutant type 33
SEQ ID No.130 Nucleotide sequence encoding the C-terminus of *homo sapiens* calreticulin mutant type 33
SEQ ID No.131 Nucleotide sequence encoding the C-terminus of *homo sapiens* calreticulin mutant type 33
SEQ ID No.132 Amino acid sequence of the C-terminus of *homo sapiens* calreticulin mutant type 33
SEQ ID No.133 Nucleotide sequence encoding the C-terminus of *homo sapiens* calreticulin mutant type 34
SEQ ID No.134 Nucleotide sequence encoding the C-terminus of *homo sapiens* calreticulin mutant type 34
SEQ ID No.135 Nucleotide sequence encoding the C-terminus of *homo sapiens* calreticulin mutant type 34
SEQ ID No.136 Amino acid sequence of the C-terminus of *homo sapiens* calreticulin mutant type 34
SEQ ID No.137 Nucleotide sequence encoding the C-terminus of *homo sapiens* calreticulin mutant type 35
SEQ ID No.138 Nucleotide sequence encoding the C-terminus of *homo sapiens* calreticulin mutant type 35
SEQ ID No.139 Nucleotide sequence encoding the C-terminus of *homo sapiens* calreticulin mutant type 35
SEQ ID No.140 Amino acid sequence of the C-terminus of *homo sapiens* calreticulin mutant type 35
SEQ ID No.141 Nucleotide sequence encoding the C-terminus of *homo sapiens* calreticulin mutant type 36
SEQ ID No.142 Nucleotide sequence encoding the C-terminus of *homo sapiens* calreticulin mutant type 36
SEQ ID No.143 Nucleotide sequence encoding the C-terminus of *homo sapiens* calreticulin mutant type 36
SEQ ID No.144 Amino acid sequence of the C-terminus of *homo sapiens* calreticulin mutant type 36
SEQ ID No.145 Nucleotide sequence encoding *homo sapiens* calreticulin mutant type 1
SEQ ID No.146 Nucleotide sequence encoding *homo sapiens* calreticulin mutant type 1
SEQ ID No.147 Nucleotide sequence encoding *homo sapiens* calreticulin mutant type 1
SEQ ID No.148 Amino acid sequence of *homo sapiens* calreticulin mutant type 1
SEQ ID No.149 Nucleotide sequence encoding *homo sapiens* calreticulin mutant type 2
SEQ ID No.150 Nucleotide sequence encoding *homo sapiens* calreticulin mutant type 2
SEQ ID No.151 Nucleotide sequence encoding *homo sapiens* calreticulin mutant type 2
SEQ ID No.152 Amino acid sequence of *homo sapiens* calreticulin mutant type 2
SEQ ID No.153 Nucleotide sequence encoding *homo sapiens* calreticulin mutant type 3

SEQ ID No.154 Nucleotide sequence encoding the *homo sapiens* calreticulin mutant type 3
SEQ ID No.155 Nucleotide sequence encoding the *homo sapiens* calreticulin mutant type 3
SEQ ID No.156 Amino acid sequence of *homo sapiens* calreticulin mutant type 3
SEQ ID No.157 Nucleotide sequence encoding the *homo sapiens* calreticulin mutant type 4
SEQ ID No.158 Nucleotide sequence encoding the *homo sapiens* calreticulin mutant type 4
SEQ ID No.159 Nucleotide sequence encoding the *homo sapiens* calreticulin mutant type 4
SEQ ID No.160 Amino acid sequence of *homo sapiens* calreticulin mutant type 4
SEQ ID No.161 Nucleotide sequence encoding the *homo sapiens* calreticulin mutant type 5
SEQ ID No.162 Nucleotide sequence encoding the *homo sapiens* calreticulin mutant type 5
SEQ ID No.163 Nucleotide sequence encoding the *homo sapiens* calreticulin mutant type 5
SEQ ID No.164 Amino acid sequence of *homo sapiens* calreticulin mutant type 5
SEQ ID No.165 Nucleotide sequence encoding the *homo sapiens* calreticulin mutant type 6
SEQ ID No.166 Nucleotide sequence encoding the *homo sapiens* calreticulin mutant type 6
SEQ ID No.167 Nucleotide sequence encoding the *homo sapiens* calreticulin mutant type 6
SEQ ID No.168 Amino acid sequence of *homo sapiens* calreticulin mutant type 6
SEQ ID No.169 Nucleotide sequence encoding the *homo sapiens* calreticulin mutant type 7
SEQ ID No.170 Nucleotide sequence encoding the *homo sapiens* calreticulin mutant type 7
SEQ ID No.171 Nucleotide sequence encoding the *homo sapiens* calreticulin mutant type 7
SEQ ID No.172 Amino acid sequence of *homo sapiens* calreticulin mutant type 7
SEQ ID No.173 Nucleotide sequence encoding the *homo sapiens* calreticulin mutant type 8
SEQ ID No.174 Nucleotide sequence encoding the *homo sapiens* calreticulin mutant type 8
SEQ ID No.175 Nucleotide sequence encoding the *homo sapiens* calreticulin mutant type 8
SEQ ID No.176 Amino acid sequence of *homo sapiens* calreticulin mutant type 8
SEQ ID No.177 Nucleotide sequence encoding the *homo sapiens* calreticulin mutant type 9
SEQ ID No.178 Nucleotide sequence encoding the *homo sapiens* calreticulin mutant type 9
SEQ ID No.179 Nucleotide sequence encoding the *homo sapiens* calreticulin mutant type 9
SEQ ID No.180 Amino acid sequence of *homo sapiens* calreticulin mutant type 9
SEQ ID No.181 Nucleotide sequence encoding the *homo sapiens* calreticulin mutant type 10
SEQ ID No.182 Nucleotide sequence encoding the *homo sapiens* calreticulin mutant type 10
SEQ ID No.183 Nucleotide sequence encoding the *homo sapiens* calreticulin mutant type 10
SEQ ID No.184 Amino acid sequence of *homo sapiens* calreticulin mutant type 10
SEQ ID No.185 Nucleotide sequence encoding the *homo sapiens* calreticulin mutant type 11
SEQ ID No.186 Nucleotide sequence encoding the *homo sapiens* calreticulin mutant type 11
SEQ ID No.187 Nucleotide sequence encoding the *homo sapiens* calreticulin mutant type 11
SEQ ID No.188 Amino acid sequence of *homo sapiens* calreticulin mutant type 11
SEQ ID No.189 Nucleotide sequence encoding *homo sapiens* calreticulin mutant type 12
SEQ ID No.190 Nucleotide sequence encoding *homo sapiens* calreticulin mutant type 12
SEQ ID No.191 Nucleotide sequence encoding *homo sapiens* calreticulin mutant type 12
SEQ ID No.192 Amino acid sequence of *homo sapiens* calreticulin mutant type 12
SEQ ID No.193 Nucleotide sequence encoding *homo sapiens* calreticulin mutant type 13
SEQ ID No.194 Nucleotide sequence encoding *homo sapiens* calreticulin mutant type 13
SEQ ID No.195 Nucleotide sequence encoding *homo sapiens* calreticulin mutant type 13
SEQ ID No.196 Amino acid sequence of *homo sapiens* calreticulin mutant type 13
SEQ ID No.197 Nucleotide sequence encoding the *homo sapiens* calreticulin mutant type 14
SEQ ID No.198 Nucleotide sequence encoding the *homo sapiens* calreticulin mutant type 14
SEQ ID No.199 Nucleotide sequence encoding the *homo sapiens* calreticulin mutant type 14
SEQ ID No.200 Amino acid sequence of *homo sapiens* calreticulin mutant type 14
SEQ ID No.201 Nucleotide sequence encoding the *homo sapiens* calreticulin mutant type 15
SEQ ID No.202 Nucleotide sequence encoding the *homo sapiens* calreticulin mutant type 15
SEQ ID No.203 Nucleotide sequence encoding the *homo sapiens* calreticulin mutant type 15
SEQ ID No.204 Amino acid sequence of *homo sapiens* calreticulin mutant type 15
SEQ ID No.205 Nucleotide sequence encoding *homo sapiens* calreticulin mutant type 16
SEQ ID No.206 Nucleotide sequence encoding *homo sapiens* calreticulin mutant type 16
SEQ ID No.207 Nucleotide sequence encoding *homo sapiens* calreticulin mutant type 16
SEQ ID No.208 Amino acid sequence of *homo sapiens* calreticulin mutant type 16
SEQ ID No.209 Nucleotide sequence encoding the *homo sapiens* calreticulin mutant type 17
SEQ ID No.210 Nucleotide sequence encoding *homo sapiens* calreticulin mutant type 17
SEQ ID No.211 Nucleotide sequence encoding *homo sapiens* calreticulin mutant type 17
SEQ ID No.212 Amino acid sequence of *homo sapiens* calreticulin mutant type 17
SEQ ID No.213 Nucleotide sequence encoding *homo sapiens* calreticulin mutant type 18
SEQ ID No.214 Nucleotide sequence encoding *homo sapiens* calreticulin mutant type 18
SEQ ID No.215 Nucleotide sequence encoding the *homo sapiens* calreticulin mutant type 18
SEQ ID No.216 Amino acid sequence of *homo sapiens* calreticulin mutant type 18
SEQ ID No.217 Nucleotide sequence encoding *homo sapiens* calreticulin mutant type 19
SEQ ID No.218 Nucleotide sequence encoding *homo sapiens* calreticulin mutant type 19
SEQ ID No.219 Nucleotide sequence encoding *homo sapiens* calreticulin mutant type 19

SEQ ID No.220 Amino acid sequence of *homo sapiens* calreticulin mutant type 19
SEQ ID No.221 Nucleotide sequence encoding *homo sapiens* calreticulin mutant type 20
SEQ ID No.222 Nucleotide sequence encoding *homo sapiens* calreticulin mutant type 20
SEQ ID No.223 Nucleotide sequence encoding *homo sapiens* calreticulin mutant type 20
SEQ ID No.224 Amino acid sequence of *homo sapiens* calreticulin mutant type 20
SEQ ID No.225 Nucleotide sequence encoding *homo sapiens* calreticulin mutant type 21
SEQ ID No.226 Nucleotide sequence encoding *homo sapiens* calreticulin mutant type 21
SEQ ID No.227 Nucleotide sequence encoding *homo sapiens* calreticulin mutant type 21
SEQ ID No.228 Amino acid sequence of *homo sapiens* calreticulin mutant type 21
SEQ ID No.229 Nucleotide sequence encoding *homo sapiens* calreticulin mutant type 22
SEQ ID No.230 Nucleotide sequence encoding *homo sapiens* calreticulin mutant type 22
SEQ ID No.231 Nucleotide sequence encoding *homo sapiens* calreticulin mutant type 22
SEQ ID No.232 Amino acid sequence of *homo sapiens* calreticulin mutant type 22
SEQ ID No.233 Nucleotide sequence encoding *homo sapiens* calreticulin mutant type 23
SEQ ID No.234 Nucleotide sequence encoding *homo sapiens* calreticulin mutant type 23
SEQ ID No.235 Nucleotide sequence encoding *homo sapiens* calreticulin mutant type 23
SEQ ID No.236 Amino acid sequence of *homo sapiens* calreticulin mutant type 23
SEQ ID No.237 Nucleotide sequence encoding *homo sapiens* calreticulin mutant type 24
SEQ ID No.238 Nucleotide sequence encoding *homo sapiens* calreticulin mutant type 24
SEQ ID No.239 Nucleotide sequence encoding *homo sapiens* calreticulin mutant type 24
SEQ ID No.240 Amino acid sequence of *homo sapiens* calreticulin mutant type 24
SEQ ID No.241 Nucleotide sequence encoding *homo sapiens* calreticulin mutant type 25
SEQ ID No.242 Nucleotide sequence encoding *homo sapiens* calreticulin mutant type 25
SEQ ID No.243 Nucleotide sequence encoding *homo sapiens* calreticulin mutant type 25
SEQ ID No.244 Amino acid sequence of *homo sapiens* calreticulin mutant type 25
SEQ ID No.245 Nucleotide sequence encoding *homo sapiens* calreticulin mutant type 26
SEQ ID No.246 Nucleotide sequence encoding *homo sapiens* calreticulin mutant type 26
SEQ ID No.247 Nucleotide sequence encoding *homo sapiens* calreticulin mutant type 26
SEQ ID No.248 Amino acid sequence of *homo sapiens* calreticulin mutant type 26
SEQ ID No.249 Nucleotide sequence encoding *homo sapiens* calreticulin mutant type 27
SEQ ID No.250 Nucleotide sequence encoding *homo sapiens* calreticulin mutant type 27
SEQ ID No.251 Nucleotide sequence encoding *homo sapiens* calreticulin mutant type 27
SEQ ID No.252 Amino acid sequence of *homo sapiens* calreticulin mutant type 27
SEQ ID No.253 Nucleotide sequence encoding *homo sapiens* calreticulin mutant type 28
SEQ ID No.254 Nucleotide sequence encoding *homo sapiens* calreticulin mutant type 28
SEQ ID No.255 Nucleotide sequence encoding *homo sapiens* calreticulin mutant type 28
SEQ ID No.256 Amino acid sequence of *homo sapiens* calreticulin mutant type 28
SEQ ID No.257 Nucleotide sequence encoding *homo sapiens* calreticulin mutant type 29
SEQ ID No.258 Nucleotide sequence encoding *homo sapiens* calreticulin mutant type 29
SEQ ID No.259 Nucleotide sequence encoding *homo sapiens* calreticulin mutant type 29
SEQ ID No.260 Amino acid sequence of *homo sapiens* calreticulin mutant type 29
SEQ ID No.261 Nucleotide sequence encoding *homo sapiens* calreticulin mutant type 30
SEQ ID No.262 Nucleotide sequence encoding *homo sapiens* calreticulin mutant type 30
SEQ ID No.263 Nucleotide sequence encoding *homo sapiens* calreticulin mutant type 30
SEQ ID No.264 Amino acid sequence of *homo sapiens* calreticulin mutant type 30
SEQ ID No.265 Nucleotide sequence encoding *homo sapiens* calreticulin mutant type 31
SEQ ID No.266 Nucleotide sequence encoding *homo sapiens* calreticulin mutant type 31
SEQ ID No.267 Nucleotide sequence encoding *homo sapiens* calreticulin mutant type 31
SEQ ID No.268 Amino acid sequence of *homo sapiens* calreticulin mutant type 31
SEQ ID No.269 Nucleotide sequence encoding *homo sapiens* calreticulin mutant type 32
SEQ ID No.270 Nucleotide sequence encoding *homo sapiens* calreticulin mutant type 32
SEQ ID No.271 Nucleotide sequence encoding *homo sapiens* calreticulin mutant type 32
SEQ ID No.272 Amino acid sequence of *homo sapiens* calreticulin mutant type 32
SEQ ID No.273 Nucleotide sequence encoding *homo sapiens* calreticulin mutant type 33
SEQ ID No.274 Nucleotide sequence encoding *homo sapiens* calreticulin mutant type 33
SEQ ID No.275 Nucleotide sequence encoding *homo sapiens* calreticulin mutant type 33
SEQ ID No.276 Amino acid sequence of *homo sapiens* calreticulin mutant type 33
SEQ ID No.277 Nucleotide sequence encoding *homo sapiens* calreticulin mutant type 34
SEQ ID No.278 Nucleotide sequence encoding *homo sapiens* calreticulin mutant type 34
SEQ ID No.279 Nucleotide sequence encoding *homo sapiens* calreticulin mutant type 34
SEQ ID No.280 Amino acid sequence of *homo sapiens* calreticulin mutant type 34
SEQ ID No.281 Nucleotide sequence encoding *homo sapiens* calreticulin mutant type 35
SEQ ID No.282 Nucleotide sequence encoding *homo sapiens* calreticulin mutant type 35
SEQ ID No.283 Nucleotide sequence encoding *homo sapiens* calreticulin mutant type 35
SEQ ID No.284 Amino acid sequence of *homo sapiens* calreticulin mutant type 35
SEQ ID No.285 Nucleotide sequence encoding *homo sapiens* calreticulin mutant type 36

SEQ ID No.286 Nucleotide sequence encoding *homo sapiens* calreticulin mutant type 36
SEQ ID No.287 Nucleotide sequence encoding *homo sapiens* calreticulin mutant type 36
SEQ ID No.288 Amino acid sequence of *homo sapiens* calreticulin mutant type 36
SEQ ID No.289 Nucleotide sequence encoding *homo sapiens* calreticulin wild type
SEQ ID No.290 Amino acid sequence of *homo sapiens* calreticulin wild type
SEQ ID No.291 Nucleotide sequence encoding *homo sapiens* calreticulin exon 9 mutant type 1
SEQ ID No.292 Nucleotide sequence encoding *homo sapiens* calreticulin exon 9 mutant type 1
SEQ ID No.293 Nucleotide sequence encoding *homo sapiens* calreticulin exon 9 mutant type 1
SEQ ID No.294 Amino acid sequence of *homo sapiens* calreticulin exon 9 mutant type 1
SEQ ID No.295 Nucleotide sequence encoding *homo sapiens* calreticulin exon 9 mutant type 2
SEQ ID No.296 Nucleotide sequence encoding *homo sapiens* calreticulin exon 9 mutant type 2
SEQ ID No.297 Nucleotide sequence encoding *homo sapiens* calreticulin exon 9 mutant type 2
SEQ ID No.298 Amino acid sequence of *homo sapiens* calreticulin exon 9 mutant type 2
SEQ ID No.299 Nucleotide sequence encoding *homo sapiens* calreticulin exon 9 mutant type 3
SEQ ID No.300 Nucleotide sequence encoding *homo sapiens* calreticulin exon 9 mutant type 3
SEQ ID No.301 Nucleotide sequence encoding *homo sapiens* calreticulin exon 9 mutant type 3
SEQ ID No.302 Amino acid sequence of *homo sapiens* calreticulin exon 9 mutant type 3
SEQ ID No.303 Nucleotide sequence encoding *homo sapiens* calreticulin exon 9 mutant type 4
SEQ ID No.304 Nucleotide sequence encoding *homo sapiens* calreticulin exon 9 mutant type 4
SEQ ID No.305 Nucleotide sequence encoding *homo sapiens* calreticulin exon 9 mutant type 4
SEQ ID No.306 Amino acid sequence of *homo sapiens* calreticulin exon 9 mutant type 4
SEQ ID No.307 Nucleotide sequence encoding *homo sapiens* calreticulin exon 9 mutant type
SEQ ID No.308 Nucleotide sequence encoding *homo sapiens* calreticulin exon 9 mutant type
SEQ ID No.309 Nucleotide sequence encoding *homo sapiens* calreticulin exon 9 mutant type
SEQ ID No.310 Amino acid sequence of *homo sapiens* calreticulin exon 9 mutant type 5
SEQ ID No.311 Nucleotide sequence encoding *homo sapiens* calreticulin exon 9 mutant type 6
SEQ ID No.312 Nucleotide sequence encoding *homo sapiens* calreticulin exon 9 mutant type 6
SEQ ID No.313 Nucleotide sequence encoding *homo sapiens* calreticulin exon 9 mutant type 6
SEQ ID No.314 Amino acid sequence of *homo sapiens* calreticulin exon 9 mutant type 6
SEQ ID No.315 Nucleotide sequence encoding *homo sapiens* calreticulin exon 9 mutant type 7
SEQ ID No.316 Nucleotide sequence encoding *homo sapiens* calreticulin exon 9 mutant type
SEQ ID No.317 Nucleotide sequence encoding *homo sapiens* calreticulin exon 9 mutant type 7
SEQ ID No.318 Amino acid sequence of *homo sapiens* calreticulin exon 9 mutant type 7
SEQ ID No.319 Nucleotide sequence encoding *homo sapiens* calreticulin exon 9 mutant type 8
SEQ ID No.320 Nucleotide sequence encoding *homo sapiens* calreticulin exon 9 mutant type 8
SEQ ID No.321 Nucleotide sequence encoding *homo sapiens* calreticulin exon 9 mutant type 8
SEQ ID No.322 Amino acid sequence of *homo sapiens* calreticulin exon 9 mutant type 8
SEQ ID No.323 Nucleotide sequence encoding *homo sapiens* calreticulin exon 9 mutant type 9
SEQ ID No.324 Nucleotide sequence encoding *homo sapiens* calreticulin exon 9 mutant type 9
SEQ ID No.325 Nucleotide sequence encoding *homo sapiens* calreticulin exon 9 mutant type 9
SEQ ID No.326 Amino acid sequence of *homo sapiens* calreticulin exon 9 mutant type 9
SEQ ID No.327 Nucleotide sequence encoding *homo sapiens* calreticulin exon 9 mutant type
SEQ ID No.328 Nucleotide sequence encoding *homo sapiens* calreticulin exon 9 mutant type
SEQ ID No.329 Nucleotide sequence encoding *homo sapiens* calreticulin exon 9 mutant type
SEQ ID No.330 Amino acid sequence of *homo sapiens* calreticulin exon 9 mutant type 10
SEQ ID No.331 Nucleotide sequence encoding *homo sapiens* calreticulin exon 9 mutant type 11
SEQ ID No.332 Nucleotide sequence encoding *homo sapiens* calreticulin exon 9 mutant type 11
SEQ ID No.333 Nucleotide sequence encoding *homo sapiens* calreticulin exon 9 mutant type 11
SEQ ID No.334 Amino acid sequence of *homo sapiens* calreticulin exon 9 mutant type 11
SEQ ID No.335 Nucleotide sequence encoding *homo sapiens* calreticulin exon 9 mutant type 12
SEQ ID No.336 Nucleotide sequence encoding *homo sapiens* calreticulin exon 9 mutant type 12
SEQ ID No.337 Nucleotide sequence encoding *homo sapiens* calreticulin exon 9 mutant type 12
SEQ ID No.338 Amino acid sequence of *homo sapiens* calreticulin exon 9 mutant type 12
SEQ ID No.339 Nucleotide sequence encoding *homo sapiens* calreticulin exon 9 mutant type 13
SEQ ID No.340 Nucleotide sequence encoding *homo sapiens* calreticulin exon 9 mutant type 13
SEQ ID No.341 Nucleotide sequence encoding *homo sapiens* calreticulin exon 9 mutant type 13
SEQ ID No.342 Amino acid sequence of *homo sapiens* calreticulin exon 9 mutant type 13
SEQ ID No.343 Nucleotide sequence encoding *homo sapiens* calreticulin exon 9 mutant type 14
SEQ ID No.344 Nucleotide sequence encoding *homo sapiens* calreticulin exon 9 mutant type 14
SEQ ID No.345 Nucleotide sequence encoding *homo sapiens* calreticulin exon 9 mutant type 14
SEQ ID No.346 Amino acid sequence of *homo sapiens* calreticulin exon 9 mutant type 14
SEQ ID No.347 Nucleotide sequence encoding *homo sapiens* calreticulin exon 9 mutant type
SEQ ID No.348 Nucleotide sequence encoding *homo sapiens* calreticulin exon 9 mutant type SEQ ID No.349 Nucleotide sequence encoding *homo sapiens* calreticulin exon 9 mutant type
SEQ ID No.350 Amino acid sequence of *homo sapiens* calreticulin exon 9 mutant type 15
SEQ ID No.351 Nucleotide sequence encoding *homo sapiens* calreticulin exon 9 mutant type 16
SEQ ID No.352 Nucleotide sequence encoding *homo sapiens* calreticulin exon 9 mutant type
SEQ ID No.353 Nucleotide sequence encoding *homo sapiens* calreticulin exon 9 mutant type 16
SEQ ID No.354 Amino acid sequence of *homo sapiens* calreticulin exon 9 mutant type 16
SEQ ID No.355 Nucleotide sequence encoding *homo sapiens* calreticulin exon 9 mutant type 17
SEQ ID No.356 Nucleotide sequence encoding *homo sapiens* calreticulin exon 9 mutant type 17
SEQ ID No.357 Nucleotide sequence encoding *homo sapiens* calreticulin exon 9 mutant type 17
SEQ ID No.358 Amino acid sequence of *homo sapiens* calreticulin exon 9 mutant type 17
SEQ ID No.359 Nucleotide sequence encoding *homo sapiens* calreticulin exon 9 mutant type 18
SEQ ID No.360 Nucleotide sequence encoding *homo sapiens* calreticulin exon 9 mutant type 18
SEQ ID No.361 Nucleotide sequence encoding *homo sapiens* calreticulin exon 9 mutant type 18
SEQ ID No.362 Amino acid sequence of *homo sapiens* calreticulin exon 9 mutant type 18
SEQ ID No.363 Nucleotide sequence encoding *homo sapiens* calreticulin exon 9 mutant type 19
SEQ ID No.364 Nucleotide sequence encoding *homo sapiens* calreticulin exon 9 mutant type 19
SEQ ID No.365 Nucleotide sequence encoding *homo sapiens* calreticulin exon 9 mutant type 19
SEQ ID No.366 Amino acid sequence of *homo sapiens* calreticulin exon 9 mutant type 19
SEQ ID No.367 Nucleotide sequence encoding *homo sapiens* calreticulin exon 9 mutant type
SEQ ID No.368 Nucleotide sequence encoding *homo sapiens* calreticulin exon 9 mutant type
SEQ ID No.369 Nucleotide sequence encoding *homo sapiens* calreticulin exon 9 mutant type
SEQ ID No.370 Amino acid sequence of *homo sapiens* calreticulin exon 9 mutant type 20
SEQ ID No.371 Nucleotide sequence encoding *homo sapiens* calreticulin exon 9 mutant type 21
SEQ ID No.372 Nucleotide sequence encoding *homo sapiens* calreticulin exon 9 mutant type 21
SEQ ID No.373 Nucleotide sequence encoding *homo sapiens* calreticulin exon 9 mutant type 21
SEQ ID No.374 Amino acid sequence of *homo sapiens* calreticulin exon 9 mutant type 21
SEQ ID No.375 Nucleotide sequence encoding *homo sapiens* calreticulin exon 9 mutant type 22
SEQ ID No.376 Nucleotide sequence encoding *homo sapiens* calreticulin exon 9 mutant type 22
SEQ ID No.377 Nucleotide sequence encoding *homo sapiens* calreticulin exon 9 mutant type 22
SEQ ID No.378 Amino acid sequence of *homo sapiens* calreticulin exon 9 mutant type 22
SEQ ID No.379 Nucleotide sequence encoding *homo sapiens* calreticulin exon 9 mutant type 23
SEQ ID No.380 Nucleotide sequence encoding *homo sapiens* calreticulin exon 9 mutant type 23
SEQ ID No.381 Nucleotide sequence encoding *homo sapiens* calreticulin exon 9 mutant type 23
SEQ ID No.382 Amino acid sequence of *homo sapiens* calreticulin exon 9 mutant type 23
SEQ ID No.383 Nucleotide sequence encoding *homo sapiens* calreticulin exon 9 mutant type 24
SEQ ID No.384 Nucleotide sequence encoding *homo sapiens* calreticulin exon 9 mutant type 24
SEQ ID No.385 Nucleotide sequence encoding *homo sapiens* calreticulin exon 9 mutant type 24
SEQ ID No.386 Amino acid sequence of *homo sapiens* calreticulin exon 9 mutant type 24
SEQ ID No.387 Nucleotide sequence encoding *homo sapiens* calreticulin exon 9 mutant type
SEQ ID No.388 Nucleotide sequence encoding *homo sapiens* calreticulin exon 9 mutant type
SEQ ID No.389 Nucleotide sequence encoding *homo sapiens* calreticulin exon 9 mutant type
SEQ ID No.390 Amino acid sequence of *homo sapiens* calreticulin exon 9 mutant type 25
SEQ ID No.391 Nucleotide sequence encoding *homo sapiens* calreticulin exon 9 mutant type 26
SEQ ID No.392 Nucleotide sequence encoding *homo sapiens* calreticulin exon 9 mutant type 26
SEQ ID No.393 Nucleotide sequence encoding *homo sapiens* calreticulin exon 9 mutant type 26
SEQ ID No.394 Amino acid sequence of *homo sapiens* calreticulin exon 9 mutant type 26
SEQ ID No.395 Nucleotide sequence encoding *homo sapiens* calreticulin exon 9 mutant type 27
SEQ ID No.396 Nucleotide sequence encoding *homo sapiens* calreticulin exon 9 mutant type 27
SEQ ID No.397 Nucleotide sequence encoding *homo sapiens* calreticulin exon 9 mutant type 27
SEQ ID No.398 Amino acid sequence of *homo sapiens* calreticulin exon 9 mutant type 27
SEQ ID No.399 Nucleotide sequence encoding *homo sapiens* calreticulin exon 9 mutant type 28
SEQ ID No.400 Nucleotide sequence encoding *homo sapiens* calreticulin exon 9 mutant type 28
SEQ ID No.401 Nucleotide sequence encoding *homo sapiens* calreticulin exon 9 mutant type 28
SEQ ID No.402 Amino acid sequence of *homo sapiens* calreticulin exon 9 mutant type 28
SEQ ID No.403 Nucleotide sequence encoding *homo sapiens* calreticulin exon 9 mutant type 29
SEQ ID No.404 Nucleotide sequence encoding *homo sapiens* calreticulin exon 9 mutant type 29
SEQ ID No.405 Nucleotide sequence encoding *homo sapiens* calreticulin exon 9 mutant type 29
SEQ ID No.406 Amino acid sequence of *homo sapiens* calreticulin exon 9 mutant type 29
SEQ ID No.407 Nucleotide sequence encoding *homo sapiens* calreticulin exon 9 mutant type
SEQ ID No.408 Nucleotide sequence encoding *homo sapiens* calreticulin exon 9 mutant type
SEQ ID No.409 Nucleotide sequence encoding *homo sapiens* calreticulin exon 9 mutant type SEQ ID No.410 Amino acid sequence of *homo sapiens* calreticulin exon 9 mutant type 30

SEQ ID No.411 Nucleotide sequence encoding *homo sapiens* calreticulin exon 9 mutant type 31

SEQ ID No.412 Nucleotide sequence encoding *homo sapiens* calreticulin exon 9 mutant type 31

SEQ ID No.413 Nucleotide sequence encoding *homo sapiens* calreticulin exon 9 mutant type 31

SEQ ID No.414 Amino acid sequence of *homo sapiens* calreticulin exon 9 mutant type 31

SEQ ID No.415 Nucleotide sequence encoding *homo sapiens* calreticulin exon 9 mutant type 32

SEQ ID No.416 Nucleotide sequence encoding *homo sapiens* calreticulin exon 9 mutant type 32

SEQ ID No.417 Nucleotide sequence encoding *homo sapiens* calreticulin exon 9 mutant type 32

SEQ ID No.418 Amino acid sequence of *homo sapiens* calreticulin exon 9 mutant type 32

SEQ ID No.419 Nucleotide sequence encoding *homo sapiens* calreticulin exon 9 mutant type 33

SEQ ID No.420 Nucleotide sequence encoding *homo sapiens* calreticulin exon 9 mutant type 33

SEQ ID No.421 Nucleotide sequence encoding *homo sapiens* calreticulin exon 9 mutant type 33

SEQ ID No.422 Amino acid sequence of *homo sapiens* calreticulin exon 9 mutant type 33

SEQ ID No.423 Nucleotide sequence encoding *homo sapiens* calreticulin exon 9 mutant type 34

SEQ ID No.424 Nucleotide sequence encoding *homo sapiens* calreticulin exon 9 mutant type SEQ ID No.425 Nucleotide sequence encoding *homo sapiens* calreticulin exon 9 mutant type 34

SEQ ID No.426 Amino acid sequence of *homo sapiens* calreticulin exon 9 mutant type 34

SEQ ID No.427 Nucleotide sequence encoding *homo sapiens* calreticulin exon 9 mutant type SEQ ID No.428 Nucleotide sequence encoding *homo sapiens* calreticulin exon 9 mutant type SEQ ID No.429 Nucleotide sequence encoding *homo sapiens* calreticulin exon 9 mutant type SEQ ID No.430 Amino acid sequence of *homo sapiens* calreticulin exon 9 mutant type 35

SEQ ID No.431 Nucleotide sequence encoding *homo sapiens* calreticulin exon 9 mutant type 36

SEQ ID No.432 Nucleotide sequence encoding *homo sapiens* calreticulin exon 9 mutant type 36

SEQ ID No.433 Nucleotide sequence encoding *homo sapiens* calreticulin exon 9 mutant type 36

SEQ ID No.434 Amino acid sequence of *homo sapiens* calreticulin exon 9 mutant type 36

SEQ ID No.435 Nucleotide sequence encoding *homo sapiens* calreticulin exon 9 wild type SEQ ID No.436 Amino acid sequence of *homo sapiens* calreticulin exon 9 wild type The following TABLE 10 provides an overview of herein provided and used SEQ ID NOs.

TABLE 10

| | SEQ ID NO | | | |
|---|---|---|---|---|
| | genomic DNA | copy(c)DNA | mRNA | protein |
| C-terminus (minimum sequence) of mutant calreticulin | 1 | 2 | 3 | 4 |
| C-termini of mutant calreticulin | | | | |
| type 1 | 5 | 6 | 7 | 8 |
| type 2 | 9 | 10 | 11 | 12 |
| type 3 | 13 | 14 | 15 | 16 |
| type 4 | 17 | 18 | 19 | 20 |
| type 5 | 21 | 22 | 23 | 24 |
| type 6 | 25 | 26 | 27 | 28 |
| type 7 | 29 | 30 | 31 | 32 |
| type 8 | 33 | 34 | 35 | 36 |
| type 9 | 37 | 38 | 39 | 40 |
| type 10 | 41 | 42 | 43 | 44 |
| type 11 | 45 | 46 | 47 | 48 |
| type 12 | 49 | 50 | 51 | 52 |
| type 13 | 53 | 54 | 55 | 56 |
| type 14 | 57 | 58 | 59 | 60 |
| type 15 | 61 | 62 | 63 | 64 |
| type 16 | 65 | 66 | 67 | 68 |
| type 17 | 69 | 70 | 71 | 72 |
| type 18 | 1 | 2 | 3 | 4 |
| type 19 | 73 | 74 | 75 | 76 |
| type 20 | 77 | 78 | 79 | 80 |
| type 21 | 81 | 82 | 83 | 84 |
| type 22 | 85 | 86 | 87 | 88 |
| type 23 | 89 | 90 | 91 | 92 |
| type 24 | 93 | 94 | 95 | 96 |
| type 25 | 97 | 98 | 99 | 100 |
| type 26 | 101 | 102 | 103 | 104 |
| type 27 | 105 | 106 | 107 | 108 |
| type 28 | 109 | 110 | 111 | 112 |
| type 29 | 113 | 114 | 115 | 116 |
| type 30 | 117 | 118 | 119 | 120 |
| type 31 | 121 | 122 | 123 | 124 |
| type 32 | 125 | 126 | 127 | 128 |
| type 33 | 129 | 130 | 131 | 132 |
| type 34 | 133 | 134 | 135 | 136 |
| type 35 | 137 | 138 | 139 | 140 |
| type 36 | 141 | 142 | 143 | 144 |
| full length mutant calreticulin | | | | |
| type 1 | 145 | 146 | 147 | 148 |
| type 2 | 149 | 150 | 151 | 152 |
| type 3 | 153 | 154 | 155 | 156 |
| type 4 | 157 | 158 | 159 | 160 |
| type 5 | 161 | 162 | 163 | 164 |
| type 6 | 165 | 166 | 167 | 168 |
| type 7 | 169 | 170 | 171 | 172 |
| type 8 | 173 | 174 | 175 | 176 |
| type 9 | 177 | 178 | 179 | 180 |
| type 10 | 181 | 182 | 183 | 184 |
| type 11 | 185 | 186 | 187 | 188 |
| type 12 | 189 | 190 | 191 | 192 |
| type 13 | 193 | 194 | 195 | 196 |
| type 14 | 197 | 198 | 199 | 200 |
| type 15 | 201 | 202 | 203 | 204 |
| type 16 | 205 | 206 | 207 | 208 |
| type 17 | 209 | 210 | 211 | 212 |
| type 18 | 213 | 214 | 215 | 216 |
| type 19 | 217 | 218 | 219 | 220 |
| type 20 | 221 | 222 | 223 | 224 |
| type 21 | 225 | 226 | 227 | 228 |
| type 22 | 229 | 230 | 231 | 232 |
| type 23 | 233 | 234 | 235 | 236 |
| type 24 | 237 | 238 | 239 | 240 |
| type 25 | 241 | 242 | 243 | 244 |
| type 26 | 245 | 246 | 247 | 248 |
| type 27 | 249 | 250 | 251 | 252 |
| type 28 | 253 | 254 | 255 | 256 |
| type 29 | 257 | 258 | 259 | 260 |
| type 30 | 261 | 262 | 263 | 264 |
| type 31 | 265 | 266 | 267 | 268 |

TABLE 10-continued

| | SEQ ID NO | | | |
|---|---|---|---|---|
| | genomic DNA | copy(c)DNA | mRNA | protein |
| type 32 | 269 | 270 | 271 | 272 |
| type 33 | 273 | 274 | 275 | 276 |
| type 34 | 277 | 278 | 279 | 280 |
| type 35 | 281 | 282 | 283 | 284 |
| type 36 | 285 | 286 | 287 | 288 |
| full length wild-type calreticulin | 289 | | | 290 |
| Exon 9 of mutant calreticulin | | | | |
| type 1 | 291 | 292 | 293 | 294 |
| type 2 | 295 | 296 | 297 | 298 |
| type 3 | 299 | 300 | 301 | 302 |
| type 4 | 303 | 304 | 305 | 306 |
| type 5 | 307 | 308 | 309 | 310 |
| type 6 | 311 | 312 | 313 | 314 |
| type 7 | 315 | 316 | 317 | 318 |
| type 8 | 319 | 320 | 321 | 322 |
| type 9 | 323 | 324 | 325 | 326 |
| type 10 | 327 | 328 | 329 | 330 |
| type 11 | 331 | 332 | 333 | 334 |
| type 12 | 335 | 336 | 337 | 338 |
| type 13 | 339 | 340 | 341 | 342 |
| type 14 | 343 | 344 | 345 | 346 |
| type 15 | 347 | 348 | 349 | 350 |
| type 16 | 351 | 352 | 353 | 354 |
| type 17 | 355 | 356 | 357 | 358 |
| type 18 | 359 | 360 | 361 | 362 |
| type 19 | 363 | 364 | 365 | 366 |
| type 20 | 367 | 368 | 369 | 370 |
| type 21 | 371 | 372 | 373 | 374 |
| type 22 | 375 | 376 | 377 | 378 |
| type 23 | 379 | 380 | 381 | 382 |
| type 24 | 383 | 384 | 385 | 386 |
| type 25 | 387 | 388 | 389 | 390 |
| type 26 | 391 | 392 | 393 | 394 |
| type 27 | 395 | 396 | 397 | 398 |
| type 28 | 399 | 400 | 401 | 402 |
| type 29 | 403 | 404 | 405 | 406 |
| type 30 | 407 | 408 | 409 | 410 |
| type 31 | 411 | 412 | 413 | 414 |
| type 32 | 415 | 416 | 417 | 418 |
| type 33 | 419 | 420 | 421 | 422 |
| type 34 | 423 | 424 | 425 | 426 |
| type 35 | 427 | 428 | 429 | 430 |
| type 36 | 431 | 432 | 433 | 434 |
| Exon 9 of wild-type calreticulin | 435 | | | 436 |

REFERENCES

Barbui T, Barosi G, Birgegard G, et al. Philadelphia-negative classical myeloproliferative neoplasms: critical concepts and management recommendations from European LeukemiaNet. J Clin Oncol 2011; 29:761-70.

Baxter E J, Scott L M, Campbell P J, East C, Fourouclas N, Swanton S, Vassiliou G S, Bench A J, Boyd E M, Curtin N, Scott M A, Erber W N, Green A R (2005) Acquired mutation of the tyrosine kinase JAK2 in human myeloproliferative disorders. Lancet 365(9464): 1054-1061

Campbell P J, Green A R (2006a) The myeloproliferative disorders. N Engl J Med 355(23): 2452-2466

Campbell P J, Griesshammer M, Dohner K, et al. V617F mutation in JAK2 is associated with poorer survival in idiopathic myelofibrosis. Blood 2006b; 107:2098-100.

Coe H, Jung J, Groenendyk J, Prins D, Michalak M. ERp57 modulates STAT3 signaling from the lumen of the endoplasmic reticulum. J Biol Chem 2010; 285:6725-38.

Corvinus F M, Orth C, Moriggl R, et al. Persistent STAT3 activation in colon cancer is associated with enhanced cell proliferation and tumor growth. Neoplasia 2005; 7:545-55.

Delhommeau F, Dupont S, Della Valle V, James C, Trannoy S, Masse A, Kosmider O, Le Couedic J P, Robert F, Alberdi A, Lecluse Y, Plo I, Dreyfus F J, Marzac C, Casadevall N, Lacombe C, Romana S P, Dessen P, Soulier J, Viguie F, Fontenay M, Vainchenker W, Bernard O A (2009) Mutation in TET2 in myeloid cancers. N Engl J Med 360(22): 2289-2301

DePristo M A, Banks E, Poplin R, Garimella K V, Maguire J R, Hard C, Philippakis A A, del Angel G, Rivas M A, Hanna M, McKenna A, Fennell T J, Kernytsky A M, Sivachenko A Y, Cibulskis K, Gabriel S B, Altshuler D, Daly M J (2011) A framework for variation discovery and genotyping using next-generation DNA sequencing data. Nat Genet. 43(5): 491-498

Ernst T, Chase A J, Score J, Hidalgo-Curtis C E, Bryant C, Jones A V, Waghorn K, Zoi K, Ross F M, Reiter A, Hochhaus A, Drexler H G, Duncombe A, Cervantes F, Oscier D, Boultwood J, Grand F H, Cross N C (2010) Inactivating mutations of the histone methyltransferase gene EZH2 in myeloid disorders. Nat Genet. 42(8): 722-726

Harutyunyan A, Klampfl T, Cazzola M, Kralovics R (2011) p53 lesions in leukemic transformation. N Engl J Med 364(5): 488-490

Kalbfleisch J D, Prentice R L. The statistical analysis of failure time data. New YorK: Wiley; 1980.

James C, Ugo V, Le Couedic J P, Staerk J, Delhommeau F, Lacout C, Garcon L, Raslova H, Berger R, Bennaceur-Griscelli A, Villeval J L, Constantinescu S N, Casadevall N, Vainchenker W (2005) A unique clonal JAK2 mutation leading to constitutive signalling causes polycythaemia vera. Nature 434(7037): 1144-1148

Klampfl T, Harutyunyan A, Berg T, Gisslinger B, Schalling M, Bagienski K, Olcaydu D, Passamonti F, Rumi E, Pietra D, Jager R, Pieri L, Guglielmelli P, Iacobucci I, Martinelli G, Cazzola M, Vannucchi A M, Gisslinger H, Kralovics R (2011) Genome integrity of myeloproliferative neoplasms in chronic phase and during disease progression. Blood 118(1): 167-176

Koboldt D C, Zhang Q, Larson D E, Shen D, McLellan M D, Lin L, Miller C A, Mardis E R, Ding L, Wilson R K (2012) VarScan 2: somatic mutation and copy number alteration discovery in cancer by exome sequencing. Genome Res 22(3): 568-576

Kralovics R (2008) Genetic complexity of myeloproliferative neoplasms. Leukemia 22(10): 1841-1848

Kralovics R, Passamonti F, Buser A S, Teo S S, Tiedt R, Passweg J R, Tichelli A, Cazzola M, Skoda R C (2005) A gain-of-function mutation of JAK2 in myeloproliferative disorders. N Engl J Med 352(17): 1779-1790

Levine R L, Wadleigh M, Cools J, Ebert B L, Wernig G, Huntly B J, Boggon T J, Wlodarska I, Clark J J, Moore S, Adelsperger J, Koo S, Lee J C, Gabriel S, Mercher T, D'Andrea A, Frohling S, Dohner K, Marynen P, Vandenberghe P, Mesa R A, Tefferi A, Griffin J D, Eck M J, Sellers W R, Meyerson M, Golub T R, Lee S J, Gilliland D G (2005) Activating mutation in the tyrosine kinase JAK2 in polycythemia vera, essential thrombocythemia, and myeloid metaplasia with myelofibrosis. Cancer Cell 7(4): 387-397

Li H, Durbin R (2009) Fast and accurate short read alignment with Burrows-Wheeler transform. Bioinformatics 25(14): 1754-1760

Li H, Handsaker B, Wysoker A, Fennell T, Ruan J, Horner N, Marth G, Abecasis G, Durbin R (2009) The Sequence Alignment/Map format and SAMtools. Bioinformatics 25(16): 2078-2079

Li S, Kralovics R, De Libero G, Theocharides A, Gisslinger H, Skoda R C. Clonal heterogeneity in polycythemia vera patients with JAK2 exon12 and JAK2-V617F mutations. Blood 2008; 111:3863-6.

Malcovati L, Della Porta M G, Pietra D, et al. Molecular and clinical features of refractory anemia with ringed sideroblasts associated with marked thrombocytosis. Blood 2009; 114:3538-45.

Marchioli R, Finazzi G, Specchia G, et al. Cardiovascular events and intensity of treatment in polycythemia vera. N Engl J Med 2013; 368:22-33.

McKenna A, Hanna M, Banks E, Sivachenko A, Cibulskis K, Kernytsky A, Garimella K, Altshuler D, Gabriel S, Daly M, DePristo M A (2010) The Genome Analysis Toolkit: a MapReduce framework for analyzing next-generation DNA sequencing data. Genome Res 20(9): 1297-1303

Milosevic J D, Kralovics R (2013) Genetic and epigenetic alterations of myeloproliferative disorders. Int J Hematol Pardanani A D, Levine R L, Lasho T, Pikman Y, Mesa R A, Wadleigh M, Steensma D P, Elliott M A, Wolanskyj A P, Hogan W J, McClure R F, Litzow M R, Gilliland D G, Tefferi A (2006) MPL515 mutations in myeloproliferative and other myeloid disorders: a study of 1182 patients. Blood 108(10): 3472-3476

Passamonti F, Rumi E, Pungolino E, et al. Life expectancy and prognostic factors for survival in patients with polycythemia vera and essential thrombocythemia. Am J. Med. 2004; 117(10):755-61.

Passamonti F, Rumi E, Pietra D, et al. A prospective study of 338 patients with polycythemia vera: the impact of JAK2 (V617F) allele burden and leukocytosis on fibrotic or leukemic disease transformation and vascular complications. Leukemia 2010a; 24:1574-9.

Passamonti F, Cervantes F, Vannucchi A M, et al. A dynamic prognostic model to predict survival in primary myelofibrosis: a study by the IWG-MRT (International Working Group for Myeloproliferative Neoplasms Research and Treatment). Blood 2010b; 115:1703-8.

Passamonti F, Elena C, Schnittger S, et al. Molecular and clinical features of the myeloproliferative neoplasm associated with JAK2 exon 12 mutations. Blood 2011; 117: 2813-6.

Passamonti F, Thiele J, Girodon F, et al. A prognostic model to predict survival in 867 World Health Organization-defined essential thrombocythemia at diagnosis: a study by the International Working Group on Myelofibrosis Research and Treatment. Blood 2012; 120:1197-201.

Pikman Y, Lee B H, Mercher T, McDowell E, Ebert B L, Gozo M, Cuker A, Wernig G, Moore S, Galinsky I, DeAngelo D J, Clark J J, Lee S J, Golub T R, Wadleigh M, Gilliland D G, Levine R L (2006) MPLW515L is a novel somatic activating mutation in myelofibrosis with myeloid metaplasia. PLoS Med 3(7): e270

R Core Team. R: A language and environment for statistical computing: R Foundation for Statistical Computing, Vienna, Austria; 2012.

Rumi E, Pietra D, Guglielmelli P, et al. Acquired copy-neutral loss of heterozygosity of chromosome 1p as a molecular event associated with marrow fibrosis in MPL-mutated myeloproliferative neoplasms. Blood 2013; 121:4388-95.

Schafer A I. Thrombocytosis. N Engl J Med 2004; 350:1211-9.

Scott L M, Tong W, Levine R L, Scott M A, Beer P A, Stratton M R, Futreal P A, Erber W N, McMullin M F, Harrison C N, Warren A J, Gilliland D G, Lodish H F, Green A R (2007) JAK2 exon 12 mutations in polycythemia vera and idiopathic erythrocytosis. N Engl J Med 356(5): 459-468

Si J, Collins S J. Activated Ca2+/calmodulin-dependent protein kinase IIgamma is a critical regulator of myeloid leukemia cell proliferation. Cancer Res 2008; 68:3733-42.

Stegelmann F, Bullinger L, Schlenk R F, Paschka P, Griesshammer M, Blersch C, Kuhn S, Schauer S, Dohner H, Dohner K (2011) DNMT3A mutations in myeloproliferative neoplasms. Leukemia 25(7): 1217-1219

Stein B L, Williams D M, O'Keefe C, Rogers O, Ingersoll R G, Spivak J L, Verma A, Maciejewski J P, McDevitt M A, Moliterno A R (2011) Disruption of the ASXL1 gene is frequent in primary, post-essential thrombocytosis and post-polycythemia vera myelofibrosis, but not essential thrombocytosis or polycythemia vera: analysis of molecular genetics and clinical phenotypes. Haematologica 96(10): 1462-1469

Swerdlow S, Campo E, Harris N, Jaffe E, Pileri S, Stein H, Thiele J, Vardiman J (2008) WHO Classification of Tumours of Haematopoietic and Lymphoid Tissues, Lyon: International Agency for Research on Cancer.

Thiele J, Kvasnicka H M, Facchetti F, Franco V, van der Walt J, Orazi A. European consensus on grading bone marrow fibrosis and assessment of cellularity. Haematologica 2005; 90:1128-32.

Wang K, Li M, Hakonarson H (2010) ANNOVAR: functional annotation of genetic variants from high-throughput sequencing data. Nucleic Acids Res 38(16): e164

Vardiman J W, Harris N L, Brunning R D. The World Health Organization (WHO) classification of the myeloid neoplasms. Blood 2002; 100:2292-302.

Yue X, Wang H, Zhao F, et al. Hepatitis B virus-induced calreticulin protein is involved in IFN resistance. J Immunol 2012; 189:279-86.

Zuber J, McJunkin K, Fellmann C, et al. Toolkit for evaluating genes required for proliferation and survival using tetracycline-regulated RNAi. Nature biotechnology 2011; 29:79-83.

All references cited herein are fully incorporated by reference. Having now fully described the invention, it will be understood by a person skilled in the art that the invention may be practiced within a wide and equivalent range of conditions, parameters and the like, without affecting the spirit or scope of the invention or any embodiment thereof.

SEQUENCE LISTING (1350 sequences)

SEQ ID NO: 1 - DNA, 132 bp, Homo sapiens
  Nucleotide sequence encoding the C-terminus of Homo sapiens calreticulin mutant type 18
aggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 2 - DNA, 132 bp, Homo sapiens; identical to SEQ ID NO: 1
  Nucleotide sequence encoding the C-terminus of Homo sapiens calreticulin mutant type 18

SEQ ID NO: 3 - RNA, 132 nt, Homo sapiens
  Nucleotide sequence encoding the C-terminus of Homo sapiens calreticulin mutant type 18
aggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 4 - protein, 43 aa, Homo sapiens
  Amino acid sequence of the C-terminus of Homo sapiens calreticulin mutant type 18
RMMRTKMRMRRMRRTRRKMRRKMSPARPRTSCREACLQGWTEA

SEQ ID NO: 5 - DNA, 138 bp, Homo sapiens
  Nucleotide sequence encoding the C-terminus of Homo sapiens calreticulin mutant type 1
acaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 6 - DNA, 138 bp, Homo sapiens; identical to SEQ ID NO: 5
  Nucleotide sequence encoding the C-terminus of Homo sapiens calreticulin mutant type 1

SEQ ID NO: 7 - RNA, 138 nt, Homo sapiens
  Nucleotide sequence encoding the C-terminus of Homo sapiens calreticulin mutant type 1
acaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 8 - protein, 45 aa, Homo sapiens
  Amino acid sequence of the C-terminus of Homo sapiens calreticulin mutant type 1
TRRMMRTKMRMRRMRRTRRKMRRKMSPARPRTSCREACLQGWTEA

SEQ ID NO: 9 - DNA, 141 bp, Homo sapiens
  Nucleotide sequence encoding the C-terminus of Homo sapiens calreticulin mutant type 2
aattgtcggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 10 - DNA, 141 bp, Homo sapiens; identical to SEQ ID NO: 9
  Nucleotide sequence encoding the C-terminus of Homo sapiens calreticulin mutant type 2

SEQ ID NO: 11 - RNA, 141 nt, Homo sapiens
  Nucleotide sequence encoding the C-terminus of Homo sapiens calreticulin mutant type 2
aauugucggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 12 - protein, 46 aa, Homo sapiens
  Amino acid sequence of the C-terminus of Homo sapiens calreticulin mutant type 2
NCRRMMRTKMRMRRMRRTRRKMRRKMSPARPRTSCREACLQGWTEA

SEQ ID NO: 13 - DNA, 144 bp, Homo sapiens
  Nucleotide sequence encoding the C-terminus of Homo sapiens calreticulin mutant type 3
cagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 14 - DNA, 144 bp, Homo sapiens; identical to SEQ ID NO: 13
  Nucleotide sequence encoding the C-terminus of Homo sapiens calreticulin mutant type 3

SEQ ID NO: 15 - RNA, 144 nt, Homo sapiens
  Nucleotide sequence encoding the C-terminus of Homo sapiens calreticulin mutant type 3
cagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 16 - protein, 47 aa, Homo sapiens
  Amino acid sequence of the C-terminus of Homo sapiens calreticulin mutant type 3
QRTRRMMRTKMRMRRMRRTRRKMRRKMSPARPRTSCREACLQGWTEA

SEQ ID NO: 17 - DNA, 153 bp, Homo sapiens
  Nucleotide sequence encoding the C-terminus of Homo sapiens calreticulin mutant type 4
aggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 18 - DNA, 153 bp, Homo sapiens; identical to SEQ ID NO: 17
  Nucleotide sequence encoding the C-terminus of Homo sapiens calreticulin mutant type 4

SEQ ID NO: 19 - RNA, 153 nt, Homo sapiens
  Nucleotide sequence encoding the C-terminus of Homo sapiens calreticulin mutant type 4
aggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 20 - protein, 50 aa, Homo sapiens
  Amino acid sequence of the C-terminus of Homo sapiens calreticulin mutant type 4
RRRQRTRRMMRTKMRMRRMRRTRRKMRRKMSPARPRTSCREACLQGWTEA

SEQ ID NO: 21 - DNA, 147 bp, Homo sapiens
  Nucleotide sequence encoding the C-terminus of Homo sapiens calreticulin mutant type 5
gggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 22 - DNA, 147 bp, Homo sapiens; identical to SEQ ID NO: 21
  Nucleotide sequence encoding the C-terminus of Homo sapiens calreticulin mutant type 5

SEQ ID NO: 23 - RNA, 147 nt, Homo sapiens
  Nucleotide sequence encoding the C-terminus of Homo sapiens calreticulin mutant type 5
gggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 24 - protein, 48 aa, Homo sapiens
  Amino acid sequence of the C-terminus of Homo sapiens calreticulin mutant type 5
GQRTRRMMRTKMRMRRMRRTRRKMRRKMSPARPRTSCREACLQGWTEA

SEQ ID NO: 25 - DNA, 150 bp, Homo sapiens
  Nucleotide sequence encoding the C-terminus of Homo sapiens calreticulin mutant type 6
cggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 26 - DNA, 150 bp, Homo sapiens; identical to SEQ ID NO: 25
  Nucleotide sequence encoding the C-terminus of Homo sapiens calreticulin mutant type 6

SEQ ID NO: 27 - RNA, 150 nt, Homo sapiens
  Nucleotide sequence encoding the C-terminus of Homo sapiens calreticulin mutant type 6
cggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 28 - protein, 49 aa, Homo sapiens
  Amino acid sequence of the C-terminus of Homo sapiens calreticulin mutant type 6
RRQRTRRMMRTKMRMRRMRRTRRKMRRKMSPARPRTSCREACLQGWTEA

SEQ ID NO: 29 - DNA, 135 bp, Homo sapiens
  Nucleotide sequence encoding the C-terminus of Homo sapiens calreticulin mutant type 7
aggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 30 - DNA, 135 bp, Homo sapiens; identical to SEQ ID NO: 29
  Nucleotide sequence encoding the C-terminus of Homo sapiens calreticulin mutant type 7

SEQ ID NO: 31 - RNA, 135 nt, Homo sapiens
  Nucleotide sequence encoding the C-terminus of Homo sapiens calreticulin mutant type 7
aggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 32 - protein, 44 aa, Homo sapiens
  Amino acid sequence of the C-terminus of Homo sapiens calreticulin mutant type 7
RRMMRTKMRMRRMRRTRRKMRRKMSPARPRTSCREACLQGWTEA

SEQ ID NO: 33 - DNA, 150 bp, Homo sapiens
  Nucleotide sequence encoding the C-terminus of Homo sapiens calreticulin mutant type 8
aggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 34 - DNA, 150 bp, Homo sapiens; identical to SEQ ID NO: 33
  Nucleotide sequence encoding the C-terminus of Homo sapiens calreticulin mutant type 8

SEQ ID NO: 35 - RNA, 150 nt, Homo sapiens
  Nucleotide sequence encoding the C-terminus of Homo sapiens calreticulin mutant type 8
aggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 36 - protein, 49 aa, Homo sapiens; identical to SEQ ID NO: 28
  Amino acid sequence of the C-terminus of Homo sapiens calreticulin mutant type 8

SEQ ID NO: 37 - DNA, 147 bp, Homo sapiens
  Nucleotide sequence encoding the C-terminus of Homo sapiens calreticulin mutant type 9
aggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 38 - DNA, 147 bp, Homo sapiens; identical to SEQ ID NO: 37
  Nucleotide sequence encoding the C-terminus of Homo sapiens calreticulin mutant type 9

SEQ ID NO: 39 - RNA, 147 nt, Homo sapiens
  Nucleotide sequence encoding the C-terminus of Homo sapiens calreticulin mutant type 9
aggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 40 - protein, 48 aa, Homo sapiens
  Amino acid sequence of the C-terminus of Homo sapiens calreticulin mutant type 9
RQRTRRMMRTKMRMRRMRRTRRKMRRKMSPARPRTSCREACLQGWTEA

SEQ ID NO: 41 - DNA, 141 bp, Homo sapiens
  Nucleotide sequence encoding the C-terminus of Homo sapiens calreticulin mutant type 10
atgtgtcggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 42 - DNA, 141 bp, Homo sapiens; identical to SEQ ID NO: 41
  Nucleotide sequence encoding the C-terminus of Homo sapiens calreticulin mutant type 10

SEQ ID NO: 43 - RNA, 141 nt, Homo sapiens
  Nucleotide sequence encoding the C-terminus of Homo sapiens calreticulin mutant type 10
augugucggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 44 - protein, 46 aa, Homo sapiens
  Amino acid sequence of the C-terminus of Homo sapiens calreticulin mutant type 10
MCRRMMRTKMRMRRMRRTRRKMRRKMSPARPRTSCREACLQGWTEA

SEQ ID NO: 45 - DNA, 153 bp, Homo sapiens
  Nucleotide sequence encoding the C-terminus of Homo sapiens calreticulin mutant type 11
gaccagaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 46 - DNA, 153 bp, Homo sapiens; identical to SEQ ID NO: 45
  Nucleotide sequence encoding the C-terminus of Homo sapiens calreticulin mutant type 11

SEQ ID NO: 47 - RNA, 153 nt, Homo sapiens
  Nucleotide sequence encoding the C-terminus of Homo sapiens calreticulin mutant type 11
gaccagaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 48 - protein, 50 aa, Homo sapiens
  Amino acid sequence of the C-terminus of Homo sapiens calreticulin mutant type 11
DQRQRTRRMMRTKMRMRRMRRTRRKMRRKMSPARPRTSCREACLQGWTEA

SEQ ID NO: 49 - DNA, 156 bp, Homo sapiens
  Nucleotide sequence encoding the C-terminus of Homo sapiens calreticulin mutant type 12
aggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 50 - DNA, 156 bp, Homo sapiens; identical to SEQ ID NO: 49
  Nucleotide sequence encoding the C-terminus of Homo sapiens calreticulin mutant type 12

SEQ ID NO: 51 - RNA, 156 nt, Homo sapiens
  Nucleotide sequence encoding the C-terminus of Homo sapiens calreticulin mutant type 12
aggaggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 52 - protein, 51 aa, Homo sapiens
  Amino acid sequence of the C-terminus of Homo sapiens calreticulin mutant type 12
RRRRQRTRRMMRTKMRMRRMRRTRRKMRRKMSPARPRTSCREACLQGWTEA

SEQ ID NO: 53 - DNA, 156 bp, Homo sapiens
  Nucleotide sequence encoding the C-terminus of Homo sapiens calreticulin mutant type 13
cagaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 54 - DNA, 156 bp, Homo sapiens; identical to SEQ ID NO: 53
  Nucleotide sequence encoding the C-terminus of Homo sapiens calreticulin mutant type 13

SEQ ID NO: 55 - RNA, 156 nt, Homo sapiens
  Nucleotide sequence encoding the C-terminus of Homo sapiens calreticulin mutant type 13
cagaggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 56 - protein, 51 aa, Homo sapiens
  Amino acid sequence of the C-terminus of Homo sapiens calreticulin mutant type 13
QRRRQRTRRMMRTKMRMRRMRRTRRKMRRKMSPARPRTSCREACLQGWTEA

SEQ ID NO: 57 - DNA, 153 bp, Homo sapiens; identical to SEQ ID NO: 17
  Nucleotide sequence encoding the C-terminus of Homo sapiens calreticulin mutant type 14

SEQ ID NO: 58 - DNA, 153 bp, Homo sapiens; identical to SEQ ID NO: 17
  Nucleotide sequence encoding the C-terminus of Homo sapiens calreticulin mutant type 14

SEQ ID NO: 59 - RNA, 153 nt, Homo sapiens; identical to SEQ ID NO: 19
  Nucleotide sequence encoding the C-terminus of Homo sapiens calreticulin mutant type 14

SEQ ID NO: 60 - protein, 50 aa, Homo sapiens; identical to SEQ ID NO: 20
  Amino acid sequence of the C-terminus of Homo sapiens calreticulin mutant type 14

SEQ ID NO: 61 - DNA, 153 bp, Homo sapiens
  Nucleotide sequence encoding the C-terminus of Homo sapiens calreticulin mutant type 15
aggaggagggagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 62 - DNA, 153 bp, Homo sapiens; identical to SEQ ID NO: 61
  Nucleotide sequence encoding the C-terminus of Homo sapiens calreticulin mutant type 15

SEQ ID NO: 63 - RNA, 153 nt, Homo sapiens
  Nucleotide sequence encoding the C-terminus of Homo sapiens calreticulin mutant type 15
aggaggagggagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 64 - protein, 50 aa, Homo sapiens
  Amino acid sequence of the C-terminus of Homo sapiens calreticulin mutant type 15
RRRERTRRMMRTKMRMRRMRRTRRKMRRKMSPARPRTSCREACLQGWTEA

SEQ ID NO: 65 - DNA, 153 bp, Homo sapiens
  Nucleotide sequence encoding the C-terminus of Homo sapiens calreticulin mutant type 16
cagaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 66 - DNA, 153 bp, Homo sapiens; identical to SEQ ID NO: 65
  Nucleotide sequence encoding the C-terminus of Homo sapiens calreticulin mutant type 16

SEQ ID NO: 67 - RNA, 153 nt, Homo sapiens
  Nucleotide sequence encoding the C-terminus of Homo sapiens calreticulin mutant type 16
cagaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 68 - protein, 50 aa, Homo sapiens
  Amino acid sequence of the C-terminus of Homo sapiens calreticulin mutant type 16
QRRQRTRRMMRTKMRMRRMRRTRRKMRRKMSPARPRTSCREACLQGWTEA

SEQ ID NO: 69 - DNA, 150 bp, Homo sapiens
  Nucleotide sequence encoding the C-terminus of Homo sapiens calreticulin mutant type 17
aggaggcagtggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 70 - DNA, 150 bp, Homo sapiens; identical to SEQ ID NO: 69
  Nucleotide sequence encoding the C-terminus of Homo sapiens calreticulin mutant type 17

SEQ ID NO: 71 - RNA, 150 nt, Homo sapiens
  Nucleotide sequence encoding the C-terminus of Homo sapiens calreticulin mutant type 17
aggaggcaguggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 72 - protein, 49 aa, Homo sapiens
  Amino acid sequence of the C-terminus of Homo sapiens calreticulin mutant type 17
RRQWTRRMMRTKMRMRRMRRTRRKMRRKMSPARPRTSCREACLQGWTEA

SEQ ID NO: 73 - DNA, 147 bp, Homo sapiens; identical to SEQ ID NO: 37
  Nucleotide sequence encoding the C-terminus of Homo sapiens calreticulin mutant type 19

SEQ ID NO: 74 - DNA, 147 bp, Homo sapiens; identical to SEQ ID NO: 37
  Nucleotide sequence encoding the C-terminus of Homo sapiens calreticulin mutant type 19

SEQ ID NO: 75 - RNA, 147 nt, Homo sapiens; identical to SEQ ID NO: 39
  Nucleotide sequence encoding the C-terminus of Homo sapiens calreticulin mutant type 19

SEQ ID NO: 76 - protein, 48 aa, Homo sapiens; identical to SEQ ID NO: 40
  Amino acid sequence of the C-terminus of Homo sapiens calreticulin mutant type 19

SEQ ID NO: 77 - DNA, 153 bp, Homo sapiens
  Nucleotide sequence encoding the C-terminus of Homo sapiens calreticulin mutant type 20
gggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 78 - DNA, 153 bp, Homo sapiens; identical to SEQ ID NO: 77
  Nucleotide sequence encoding the C-terminus of Homo sapiens calreticulin mutant type 20

SEQ ID NO: 79 - RNA, 153 nt, Homo sapiens
  Nucleotide sequence encoding the C-terminus of Homo sapiens calreticulin mutant type 20
gggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 80 - protein, 50 aa, Homo sapiens
  Amino acid sequence of the C-terminus of Homo sapiens calreticulin mutant type 20
GRRQRTRRMMRTKMRMRRMRRTRRKMRRKMSPARPRTSCREACLQGWTEA

SEQ ID NO: 81 - DNA, 150 bp, Homo sapiens
  Nucleotide sequence encoding the C-terminus of Homo sapiens calreticulin mutant type 21
gcgtttaagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 82 - DNA, 150 bp, Homo sapiens; identical to SEQ ID NO: 81
  Nucleotide sequence encoding the C-terminus of Homo sapiens calreticulin mutant type 21

SEQ ID NO: 83 - RNA, 150 nt, Homo sapiens
  Nucleotide sequence encoding the C-terminus of Homo sapiens calreticulin mutant type 21
gcguuuaagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 84 - protein, 49 aa, Homo sapiens
  Amino acid sequence of the C-terminus of Homo sapiens calreticulin mutant type 21
AFKRTRRMMRTKMRMRRMRRTRRKMRRKMSPARPRTSCREACLQGWTEA

SEQ ID NO: 85 - DNA, 165 bp, Homo sapiens
  Nucleotide sequence encoding the C-terminus of Homo sapiens calreticulin mutant type 22
aacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 86 - DNA, 165 bp, Homo sapiens; identical to SEQ ID NO: 85
  Nucleotide sequence encoding the C-terminus of Homo sapiens calreticulin mutant type 22

SEQ ID NO: 87 - RNA, 165 nt, Homo sapiens
  Nucleotide sequence encoding the C-terminus of Homo sapiens calreticulin mutant type 22
aacgcaaagaggaggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 88 - protein, 54 aa, Homo sapiens
  Amino acid sequence of the C-terminus of Homo sapiens calreticulin mutant type 22
NAKRRRRQRTRRMMRTKMRMRRMRRTRRKMRRKMSPARPRTSCREACLQGWTEA

SEQ ID NO: 89 - DNA, 162 bp, Homo sapiens
  Nucleotide sequence encoding the C-terminus of Homo sapiens calreticulin mutant type 23
tgcgtgaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 90 - DNA, 162 bp, Homo sapiens; identical to SEQ ID NO: 89
  Nucleotide sequence encoding the C-terminus of Homo sapiens calreticulin mutant type 23

SEQ ID NO: 91 - RNA, 162 nt, Homo sapiens
  Nucleotide sequence encoding the C-terminus of Homo sapiens calreticulin mutant type 23
ugcgugaggaggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 92 - protein, 53 aa, Homo sapiens
  Amino acid sequence of the C-terminus of Homo sapiens calreticulin mutant type 23
CVRRRRQRTRRMMRTKMRMRRMRRTRRKMRRKMSPARPRTSCREACLQGWTEA

SEQ ID NO: 93 - DNA, 150 bp, Homo sapiens; identical to SEQ ID NO: 33
  Nucleotide sequence encoding the C-terminus of Homo sapiens calreticulin mutant type 24

SEQ ID NO: 94 - DNA, 150 bp, Homo sapiens; identical to SEQ ID NO: 33
  Nucleotide sequence encoding the C-terminus of Homo sapiens calreticulin mutant type 24

SEQ ID NO: 95 - RNA, 150 nt, Homo sapiens; identical to SEQ ID NO: 35
  Nucleotide sequence encoding the C-terminus of Homo sapiens calreticulin mutant type 24

SEQ ID NO: 96 - protein, 49 aa, Homo sapiens; identical to SEQ ID NO: 28
  Amino acid sequence of the C-terminus of Homo sapiens calreticulin mutant type 24

SEQ ID NO: 97 - DNA, 147 bp, Homo sapiens; identical to SEQ ID NO: 37
  Nucleotide sequence encoding the C-terminus of Homo sapiens calreticulin mutant type 25

SEQ ID NO: 98 - DNA, 147 bp, Homo sapiens; identical to SEQ ID NO: 37
  Nucleotide sequence encoding the C-terminus of Homo sapiens calreticulin mutant type 25

SEQ ID NO: 99 - RNA, 147 nt, Homo sapiens; identical to SEQ ID NO: 39
  Nucleotide sequence encoding the C-terminus of Homo sapiens calreticulin mutant type 25

SEQ ID NO: 100 - protein, 48 aa, Homo sapiens; identical to SEQ ID NO: 40
  Amino acid sequence of the C-terminus of Homo sapiens calreticulin mutant type 25

SEQ ID NO: 101 - DNA, 165 bp, Homo sapiens; identical to SEQ ID NO: 85
  Nucleotide sequence encoding the C-terminus of Homo sapiens calreticulin mutant type 26

SEQ ID NO: 102 - DNA, 165 bp, Homo sapiens; identical to SEQ ID NO: 85
  Nucleotide sequence encoding the C-terminus of Homo sapiens calreticulin mutant type 26

SEQ ID NO: 103 - RNA, 165 nt, Homo sapiens; identical to SEQ ID NO: 87
  Nucleotide sequence encoding the C-terminus of Homo sapiens calreticulin mutant type 26

SEQ ID NO: 104 - protein, 54 aa, Homo sapiens; identical to SEQ ID NO: 88
  Amino acid sequence of the C-terminus of Homo sapiens calreticulin mutant type 26

SEQ ID NO: 105 - DNA, 168 bp, Homo sapiens
  Nucleotide sequence encoding the C-terminus of Homo sapiens calreticulin mutant type 27
tgtttcgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 106 - DNA, 168 bp, Homo sapiens; identical to SEQ ID NO: 105
  Nucleotide sequence encoding the C-terminus of Homo sapiens calreticulin mutant type 27

SEQ ID NO: 107 - RNA, 168 nt, Homo sapiens
  Nucleotide sequence encoding the C-terminus of Homo sapiens calreticulin mutant type 27
uguuucgcaaagaggaggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 108 - protein, 55 aa, Homo sapiens
  Amino acid sequence of the C-terminus of Homo sapiens calreticulin mutant type 27
CFAKRRRRQRTRRMMRTKMRMRRMRRTRRKMRRKMSPARPRTSCREACLQGWTEA

SEQ ID NO: 109 - DNA, 135 bp, Homo sapiens; identical to SEQ ID NO: 29
  Nucleotide sequence encoding the C-terminus of Homo sapiens calreticulin mutant type 28

SEQ ID NO: 110 - DNA, 135 bp, Homo sapiens; identical to SEQ ID NO: 29
  Nucleotide sequence encoding the C-terminus of Homo sapiens calreticulin mutant type 28

SEQ ID NO: 111 - RNA, 135 nt, Homo sapiens; identical to SEQ ID NO: 31
  Nucleotide sequence encoding the C-terminus of Homo sapiens calreticulin mutant type 28

SEQ ID NO: 112 - protein, 44 aa, Homo sapiens; identical to SEQ ID NO: 32
  Amino acid sequence of the C-terminus of Homo sapiens calreticulin mutant type 28

SEQ ID NO: 113 - DNA, 150 bp, Homo sapiens
  Nucleotide sequence encoding the C-terminus of Homo sapiens calreticulin mutant type 29
cctcctctttgtctaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 114 - DNA, 150 bp, Homo sapiens; identical to SEQ ID NO: 113
  Nucleotide sequence encoding the C-terminus of Homo sapiens calreticulin mutant type 29

SEQ ID NO: 115 - RNA, 150 nt, Homo sapiens
  Nucleotide sequence encoding the C-terminus of Homo sapiens calreticulin mutant type 29
ccuccucuuugucuaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 116 - protein, 49 aa, Homo sapiens
  Amino acid sequence of the C-terminus of Homo sapiens calreticulin mutant type 29
PPLCLRRMMRTKMRMRRMRRTRRKMRRKMSPARPRTSCREACLQGWTEA

SEQ ID NO: 117 - DNA, 147 bp, Homo sapiens
  Nucleotide sequence encoding the C-terminus of Homo sapiens calreticulin mutant type 30
gaccatccttgtcggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 118 - DNA, 147 bp, Homo sapiens; identical to SEQ ID NO: 117
  Nucleotide sequence encoding the C-terminus of Homo sapiens calreticulin mutant type 30

SEQ ID NO: 119 - RNA, 147 nt, Homo sapiens
  Nucleotide sequence encoding the C-terminus of Homo sapiens calreticulin mutant type 30
gaccauccuugucggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 120 - protein, 48 aa, Homo sapiens
  Amino acid sequence of the C-terminus of Homo sapiens calreticulin mutant type 30
DHPCRRMMRTKMRMRRMRRTRRKMRRKMSPARPRTSCREACLQGWTEA

SEQ ID NO: 121 - DNA, 144 bp, Homo sapiens
  Nucleotide sequence encoding the C-terminus of Homo sapiens calreticulin mutant type 31
ggcaattgtcggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 122 - DNA, 144 bp, Homo sapiens; identical to SEQ ID NO: 121
  Nucleotide sequence encoding the C-terminus of Homo sapiens calreticulin mutant type 31

SEQ ID NO: 123 - RNA, 144 nt, Homo sapiens
  Nucleotide sequence encoding the C-terminus of Homo sapiens calreticulin mutant type 31
ggcaauugucggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 124 - protein, 47 aa, Homo sapiens
  Amino acid sequence of the C-terminus of Homo sapiens calreticulin mutant type 31
GNCRRMMRTKMRMRRMRRTRRKMRRKMSPARPRTSCREACLQGWTEA

SEQ ID NO: 125 - DNA, 138 bp, Homo sapiens
  Nucleotide sequence encoding the C-terminus of Homo sapiens calreticulin mutant type 32
tgtcggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 126 - DNA, 138 bp, Homo sapiens; identical to SEQ ID NO: 125
  Nucleotide sequence encoding the C-terminus of Homo sapiens calreticulin mutant type 32

SEQ ID NO: 127 - RNA, 138 nt, Homo sapiens
  Nucleotide sequence encoding the C-terminus of Homo sapiens calreticulin mutant type 32
ugucggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 128 - protein, 45 aa, Homo sapiens
  Amino acid sequence of the C-terminus of Homo sapiens calreticulin mutant type 32
CRRMMRTKMRMRRMRRTRRKMRRKMSPARPRTSCREACLQGWTEA

SEQ ID NO: 129 - DNA, 138 bp, Homo sapiens; identical to SEQ ID NO: 125
  Nucleotide sequence encoding the C-terminus of Homo sapiens calreticulin mutant type 33

SEQ ID NO: 130 - DNA, 138 bp, Homo sapiens; identical to SEQ ID NO: 125
  Nucleotide sequence encoding the C-terminus of Homo sapiens calreticulin mutant type 33

SEQ ID NO: 131 - RNA, 138 nt, Homo sapiens; identical to SEQ ID NO: 127
  Nucleotide sequence encoding the C-terminus of Homo sapiens calreticulin mutant type 33

SEQ ID NO: 132 - protein, 45 aa, Homo sapiens; identical to SEQ ID NO: 128
  Amino acid sequence of the C-terminus of Homo sapiens calreticulin mutant type 33

SEQ ID NO: 133 - DNA, 141 bp, Homo sapiens
  Nucleotide sequence encoding the C-terminus of Homo sapiens calreticulin mutant type 34
acttgtcggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 134 - DNA, 141 bp, Homo sapiens; identical to SEQ ID NO: 133
  Nucleotide sequence encoding the C-terminus of Homo sapiens calreticulin mutant type 34

SEQ ID NO: 135 - RNA, 141 nt, Homo sapiens
  Nucleotide sequence encoding the C-terminus of Homo sapiens calreticulin mutant type 34
acuugucggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 136 - protein, 46 aa, Homo sapiens
  Amino acid sequence of the C-terminus of Homo sapiens calreticulin mutant type 34
TCRRMMRTKMRMRRMRRTRRKMRRKMSPARPRTSCREACLQGWTEA

SEQ ID NO: 137 - DNA, 141 bp, Homo sapiens
  Nucleotide sequence encoding the C-terminus of Homo sapiens calreticulin mutant type 35
atttgtcggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 138 - DNA, 141 bp, Homo sapiens; identical to SEQ ID NO: 137
  Nucleotide sequence encoding the C-terminus of Homo sapiens calreticulin mutant type 35

SEQ ID NO: 139 - RNA, 141 nt, Homo sapiens
  Nucleotide sequence encoding the C-terminus of Homo sapiens calreticulin mutant type 35
auuugucggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 140 - protein, 46 aa, Homo sapiens
  Amino acid sequence of the C-terminus of Homo sapiens calreticulin mutant type 35
ICRRMMRTKMRMRRMRRTRRKMRRKMSPARPRTSCREACLQGWTEA

SEQ ID NO: 141 - DNA, 138 bp, Homo sapiens; identical to SEQ ID NO: 125
  Nucleotide sequence encoding the C-terminus of Homo sapiens calreticulin mutant type 36

SEQ ID NO: 142 - DNA, 138 bp, Homo sapiens; identical to SEQ ID NO: 125
  Nucleotide sequence encoding the C-terminus of Homo sapiens calreticulin mutant type 36

SEQ ID NO: 143 - RNA, 138 nt, Homo sapiens; identical to SEQ ID NO: 127
  Nucleotide sequence encoding the C-terminus of Homo sapiens calreticulin mutant type 36

SEQ ID NO: 144 - protein, 45 aa, Homo sapiens; identical to SEQ ID NO: 128
  Amino acid sequence of the C-terminus of Homo sapiens calreticulin mutant type 36

SEQ ID NO: 145 - DNA, 5839 bp, Homo sapiens
  Nucleotide sequence encoding Homo sapiens calreticulin mutant type 1
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 146 - DNA, 1236 bp, Homo sapiens
  Nucleotide sequence encoding Homo sapiens calreticulin mutant type 1
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 147 - RNA, 1236 nt, Homo sapiens
  Nucleotide sequence encoding Homo sapiens calreticulin mutant type 1
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 148 - protein, 411 aa, Homo sapiens
  Amino acid sequence of Homo sapiens calreticulin mutant type 1
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRTRRMMRTKMRMRRMRRTRRKMRRKMSPARPRTSCREACLQGWTEA

SEQ ID NO: 149 - DNA, 5896 bp, Homo sapiens
  Nucleotide sequence encoding Homo sapiens calreticulin mutant type 2
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagacaagaaacgcaaagaggaggaggaggcagaggacaattgtcggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 150 - DNA, 1293 bp, Homo sapiens
  Nucleotide sequence encoding Homo sapiens calreticulin mutant type 2
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaattgtcggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 151 - RNA, 1293 nt, Homo sapiens
  Nucleotide sequence encoding Homo sapiens calreticulin mutant type 2
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaaggaggaggaagaagacaagaaacgcaaagaggaggaggaggcagaggacaauugucggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 152 - protein, 430 aa, Homo sapiens
  Amino acid sequence of Homo sapiens calreticulin mutant type 2
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDNCRRMMRTKMRMRRMRRTRRKMRRKMSPARPRTSCREACLQGWTEA

SEQ ID NO: 153 - DNA, 5845 bp, Homo sapiens
  Nucleotide sequence encoding Homo sapiens calreticulin mutant type 3
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 154 - DNA, 1242 bp, Homo sapiens
  Nucleotide sequence encoding the Homo sapiens calreticulin mutant type 3
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 155 - RNA, 1242 nt, Homo sapiens
  Nucleotide sequence encoding the Homo sapiens calreticulin mutant type 3
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 156 - protein, 413 aa, Homo sapiens
  Amino acid sequence of Homo sapiens calreticulin mutant type 3
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRQRTRRMMRTKMRMRRMRRTRRKMRRKMSPARPRTSCREACLQGWTEA

SEQ ID NO: 157 - DNA, 5857 bp, Homo sapiens
  Nucleotide sequence encoding the Homo sapiens calreticulin mutant type 4
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 158 - DNA, 1254 bp, Homo sapiens
  Nucleotide sequence encoding the Homo sapiens calreticulin mutant type 4
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 159 - RNA, 1254 nt, Homo sapiens
  Nucleotide sequence encoding the Homo sapiens calreticulin mutant type 4
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 160 - protein, 417 aa, Homo sapiens
  Amino acid sequence of Homo sapiens calreticulin mutant type 4
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLRRRQRTRRMMRTKMRMRRMRRTRRKMRRKMSPARPRTSCREACLQGWTEA

SEQ ID NO: 161 - DNA, 5839 bp, Homo sapiens
  Nucleotide sequence encoding the Homo sapiens calreticulin mutant type 5
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 162 - DNA, 1236 bp, Homo sapiens
  Nucleotide sequence encoding the Homo sapiens calreticulin mutant type 5
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 163 - RNA, 1236 nt, Homo sapiens
  Nucleotide sequence encoding the Homo sapiens calreticulin mutant type 5
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 164 - protein, 411 aa, Homo sapiens
  Amino acid sequence of Homo sapiens calreticulin mutant type 5
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEGQRTRRMMRTKMRMRRMRRTRRKMRRKMSPARPRTSCREACLQGWTEA

SEQ ID NO: 165 - DNA, 5845 bp, Homo sapiens
  Nucleotide sequence encoding the Homo sapiens calreticulin mutant type 6
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 166 - DNA, 1242 bp, Homo sapiens
  Nucleotide sequence encoding the Homo sapiens calreticulin mutant type 6
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 167 - RNA, 1242 nt, Homo sapiens
  Nucleotide sequence encoding the Homo sapiens calreticulin mutant type 6
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 168 - protein, 413 aa, Homo sapiens
  Amino acid sequence of Homo sapiens calreticulin mutant type 6
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEERRQRTRRMMRTKMRMRRMRRTRRKMRRKMSPARPRTSCREACLQGWTEA

SEQ ID NO: 169 - DNA, 5839 bp, Homo sapiens
  Nucleotide sequence encoding the Homo sapiens calreticulin mutant type 7
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 170 - DNA, 1236 bp, Homo sapiens
  Nucleotide sequence encoding the Homo sapiens calreticulin mutant type 7
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 171 - RNA, 1236 nt, Homo sapiens
  Nucleotide sequence encoding the Homo sapiens calreticulin mutant type 7
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 172 - protein, 411 aa, Homo sapiens
  Amino acid sequence of Homo sapiens calreticulin mutant type 7
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLRRMMRTKMRMRRMRRTRRKMRRKMSPARPRTSCREACLQGWTEA

SEQ ID NO: 173 - DNA, 5857 bp, Homo sapiens
  Nucleotide sequence encoding the Homo sapiens calreticulin mutant type 8
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaagaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 174 - DNA, 1254 bp, Homo sapiens
  Nucleotide sequence encoding the Homo sapiens calreticulin mutant type 8
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaagaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 175 - RNA, 1254 nt, Homo sapiens
  Nucleotide sequence encoding the Homo sapiens calreticulin mutant type 8
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaagaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 176 - protein, 417 aa, Homo sapiens
  Amino acid sequence of Homo sapiens calreticulin mutant type 8
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKRRQRTRRMMRTKMRMRRMRRTRRKMRRKMSPARPRTSCREACLQGWTEA

SEQ ID NO: 177 - DNA, 5890 bp, Homo sapiens
  Nucleotide sequence encoding the Homo sapiens calreticulin mutant type 9
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagacaagaaacgcaaagaggaggagaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 178 - DNA, 1287 bp, Homo sapiens
  Nucleotide sequence encoding the Homo sapiens calreticulin mutant type 9
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggagaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 179 - RNA, 1287 nt, Homo sapiens
  Nucleotide sequence encoding the Homo sapiens calreticulin mutant type 9
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaaggaggaggaagaagacaagaaacgcaaagaggaggagaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 180 - protein, 428 aa, Homo sapiens
  Amino acid sequence of Homo sapiens calreticulin mutant type 9
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEERQRTRRMMRTKMRMRRMRRTRRKMRRKMSPARPRTSCREACLQGWTEA

SEQ ID NO: 181 - DNA, 5896 bp, Homo sapiens
  Nucleotide sequence encoding the Homo sapiens calreticulin mutant type 10
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagacaagaaacgcaaagaggaggaggaggcagaggacatgtgtcggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 182 - DNA, 1293 bp, Homo sapiens
  Nucleotide sequence encoding the Homo sapiens calreticulin mutant type 10
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacatgtgtcggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 183 - RNA, 1293 nt, Homo sapiens
  Nucleotide sequence encoding the Homo sapiens calreticulin mutant type 10
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaaggaggaggaagaagacaagaaacgcaaagaggaggaggaggcagaggacaugugucggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 184 - protein, 430 aa, Homo sapiens
  Amino acid sequence of Homo sapiens calreticulin mutant type 10
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDMCRRMMRTKMRMRRMRRTRRKMRRKMSPARPRTSCREACLQGWTEA

SEQ ID NO: 185 - DNA, 5845 bp, Homo sapiens
  Nucleotide sequence encoding the Homo sapiens calreticulin mutant type 11
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggaccagaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 186 - DNA, 1242 bp, Homo sapiens
  Nucleotide sequence encoding the Homo sapiens calreticulin mutant type 11
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggaccagaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 187 - RNA, 1242 nt, Homo sapiens
  Nucleotide sequence encoding the Homo sapiens calreticulin mutant type 11
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggaccagaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 188 - protein, 413 aa, Homo sapiens
  Amino acid sequence of Homo sapiens calreticulin mutant type 11
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEDQRQRTRRMMRTKMRMRRMRRTRRKMRRKMSPARPRTSCREACLQGWTEA

SEQ ID NO: 189 - DNA, 5857 bp, Homo sapiens
  Nucleotide sequence encoding Homo sapiens calreticulin mutant type 12
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 190 - DNA, 1254 bp, Homo sapiens
  Nucleotide sequence encoding Homo sapiens calreticulin mutant type 12
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 191 - RNA, 1254 nt, Homo sapiens
  Nucleotide sequence encoding Homo sapiens calreticulin mutant type 12
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggaggaggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 192 - protein, 417 aa, Homo sapiens
  Amino acid sequence of Homo sapiens calreticulin mutant type 12
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRRRRRQRTRRMMRTKMRMRRMRRTRRKMRRKMSPARPRTSCREACLQGWTEA

SEQ ID NO: 193 - DNA, 5857 bp, Homo sapiens
  Nucleotide sequence encoding Homo sapiens calreticulin mutant type 13
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcagaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 194 - DNA, 1254 bp, Homo sapiens
  Nucleotide sequence encoding Homo sapiens calreticulin mutant type 13
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcagaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 195 - RNA, 1254 nt, Homo sapiens
  Nucleotide sequence encoding Homo sapiens calreticulin mutant type 13
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcagaggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 196 - protein, 417 aa, Homo sapiens
  Amino acid sequence of Homo sapiens calreticulin mutant type 13
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRQRRRQRTRRMMRTKMRMRRMRRTRRKMRRKMSPARPRTSCREACLQGWTEA

SEQ ID NO: 197 - DNA, 5857 bp, Homo sapiens
  Nucleotide sequence encoding the Homo sapiens calreticulin mutant type 14
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggctgaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 198 - DNA, 1254 bp, Homo sapiens
  Nucleotide sequence encoding the Homo sapiens calreticulin mutant type 14
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggctgaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 199 - RNA, 1254 nt, Homo sapiens
  Nucleotide sequence encoding the Homo sapiens calreticulin mutant type 14
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcugaggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 200 - protein, 417 aa, Homo sapiens; identical to SEQ ID NO: 160
  Amino acid sequence of Homo sapiens calreticulin mutant type 14

SEQ ID NO: 201 - DNA, 5857 bp, Homo sapiens
  Nucleotide sequence encoding the Homo sapiens calreticulin mutant type 15
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaggaggagggagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 202 - DNA, 1254 bp, Homo sapiens
  Nucleotide sequence encoding the Homo sapiens calreticulin mutant type 15
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaggaggagggagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 203 - RNA, 1254 nt, Homo sapiens
  Nucleotide sequence encoding the Homo sapiens calreticulin mutant type 15
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaggaggagggagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 204 - protein, 417 aa, Homo sapiens
  Amino acid sequence of Homo sapiens calreticulin mutant type 15
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLRRRERTRRMMRTKMRMRRMRRTRRKMRRKMSPARPRTSCREACLQGWTEA

SEQ ID NO: 205 - DNA, 5857 bp, Homo sapiens
  Nucleotide sequence encoding Homo sapiens calreticulin mutant type 16
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttcagaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 206 - DNA, 1254 bp, Homo sapiens
  Nucleotide sequence encoding Homo sapiens calreticulin mutant type 16
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttcagaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 207 - RNA, 1254 nt, Homo sapiens
  Nucleotide sequence encoding Homo sapiens calreticulin mutant type 16
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuucagaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 208 - protein, 417 aa, Homo sapiens
  Amino acid sequence of Homo sapiens calreticulin mutant type 16
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLQRRQRTRRMMRTKMRMRRMRRTRRKMRRKMSPARPRTSCREACLQGWTEA

SEQ ID NO: 209 - DNA, 5857 bp, Homo sapiens
  Nucleotide sequence encoding the Homo sapiens calreticulin mutant type 17
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaagaggaggcagtggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 210 - DNA, 1254 bp, Homo sapiens
  Nucleotide sequence encoding Homo sapiens calreticulin mutant type 17
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaagaggaggcagtggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 211 - RNA, 1254 nt, Homo sapiens
  Nucleotide sequence encoding Homo sapiens calreticulin mutant type 17
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaagaggaggcaguggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 212 - protein, 417 aa, Homo sapiens
  Amino acid sequence of Homo sapiens calreticulin mutant type 17
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKRRQWTRRMMRTKMRMRRMRRTRRKMRRKMSPARPRTSCREACLQGWTEA

SEQ ID NO: 213 - DNA, 5839 bp, Homo sapiens
  Nucleotide sequence encoding Homo sapiens calreticulin mutant type 18
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaagaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 214 - DNA, 1236 bp, Homo sapiens
  Nucleotide sequence encoding Homo sapiens calreticulin mutant type 18
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaagaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 215 - RNA, 1236 nt, Homo sapiens
  Nucleotide sequence encoding the Homo sapiens calreticulin mutant type 18
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaagaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 216 - protein, 411 aa, Homo sapiens
  Amino acid sequence of Homo sapiens calreticulin mutant type 18
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKRMMRTKMRMRRMRRTRRKMRRKMSPARPRTSCREACLQGWTEA

SEQ ID NO: 217 - DNA, 5860 bp, Homo sapiens
  Nucleotide sequence encoding Homo sapiens calreticulin mutant type 19
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggagaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 218 - DNA, 1257 bp, Homo sapiens
  Nucleotide sequence encoding Homo sapiens calreticulin mutant type 19
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggagaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 219 - RNA, 1257 nt, Homo sapiens
  Nucleotide sequence encoding Homo sapiens calreticulin mutant type 19
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaaggaggagaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 220 - protein, 418 aa, Homo sapiens
  Amino acid sequence of Homo sapiens calreticulin mutant type 19
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEERQRTRRMMRTKMRMRRMRRTRRKMRRKMSPARPRTSCREACLQGWTEA

SEQ ID NO: 221 - DNA, 5872 bp, Homo sapiens
  Nucleotide sequence encoding Homo sapiens calreticulin mutant type 20
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 222 - DNA, 1269 bp, Homo sapiens
  Nucleotide sequence encoding Homo sapiens calreticulin mutant type 20
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 223 - RNA, 1269 nt, Homo sapiens
  Nucleotide sequence encoding Homo sapiens calreticulin mutant type 20
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaaggaggaggaagaagggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 224 - protein, 422 aa, Homo sapiens
  Amino acid sequence of Homo sapiens calreticulin mutant type 20
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEGRRQRTRRMMRTKMRMRRMRRTRRKMRRKMSPARPRTSCREACLQGWTEA

SEQ ID NO: 225 - DNA, 5869 bp, Homo sapiens
  Nucleotide sequence encoding Homo sapiens calreticulin mutant type 21
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagcgtttaagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 226 - DNA, 1266 bp, Homo sapiens
  Nucleotide sequence encoding Homo sapiens calreticulin mutant type 21
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagcgtttaagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 227 - RNA, 1266 nt, Homo sapiens
  Nucleotide sequence encoding Homo sapiens calreticulin mutant type 21
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaaggaggaggaagaagcguuuaagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 228 - protein, 421 aa, Homo sapiens
  Amino acid sequence of Homo sapiens calreticulin mutant type 21
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEAFKRTRRMMRTKMRMRRMRRTRRKMRRKMSPARPRTSCREACLQGWTEA

SEQ ID NO: 229 - DNA, 5887 bp, Homo sapiens
  Nucleotide sequence encoding Homo sapiens calreticulin mutant type 22
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagacaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 230 - DNA, 1284 bp, Homo sapiens
  Nucleotide sequence encoding Homo sapiens calreticulin mutant type 22
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 231 - RNA, 1284 nt, Homo sapiens
  Nucleotide sequence encoding Homo sapiens calreticulin mutant type 22
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaaggaggaggaagaagacaacgcaaagaggaggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 232 - protein, 427 aa, Homo sapiens
  Amino acid sequence of Homo sapiens calreticulin mutant type 22
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDNAKRRRRQRTRRMMRTKMRMRRMRRTRRKMRRKMSPARPRTSCREACLQGWTEA

SEQ ID NO: 233 - DNA, 5884 bp, Homo sapiens
  Nucleotide sequence encoding Homo sapiens calreticulin mutant type 23
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagactgcgtgaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 234 - DNA, 1281 bp, Homo sapiens
  Nucleotide sequence encoding Homo sapiens calreticulin mutant type 23
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagactgcgtgaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 235 - RNA, 1281 nt, Homo sapiens
  Nucleotide sequence encoding Homo sapiens calreticulin mutant type 23
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaaggaggaggaagaagacugcgugaggaggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 236 - protein, 426 aa, Homo sapiens
  Amino acid sequence of Homo sapiens calreticulin mutant type 23
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDCVRRRRQRTRRMMRTKMRMRRMRRTRRKMRRKMSPARPRTSCREACLQGWTEA

SEQ ID NO: 237 - DNA, 5872 bp, Homo sapiens
  Nucleotide sequence encoding Homo sapiens calreticulin mutant type 24
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagacaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 238 - DNA, 1269 bp, Homo sapiens
  Nucleotide sequence encoding Homo sapiens calreticulin mutant type 24
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 239 - RNA, 1269 nt, Homo sapiens
  Nucleotide sequence encoding Homo sapiens calreticulin mutant type 24
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaaggaggaggaagaagacaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 240 - protein, 422 aa, Homo sapiens
  Amino acid sequence of Homo sapiens calreticulin mutant type 24
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDRRQRTRRMMRTKMRMRRMRRTRRKMRRKMSPARPRTSCREACLQGWTEA

SEQ ID NO: 241 - DNA, 5872 bp, Homo sapiens
  Nucleotide sequence encoding Homo sapiens calreticulin mutant type 25
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagacaaaaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 242 - DNA, 1269 bp, Homo sapiens
  Nucleotide sequence encoding Homo sapiens calreticulin mutant type 25
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaaaaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 243 - RNA, 1269 nt, Homo sapiens
  Nucleotide sequence encoding Homo sapiens calreticulin mutant type 25
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaaggaggaggaagaagacaaaaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 244 - protein, 422 aa, Homo sapiens
  Amino acid sequence of Homo sapiens calreticulin mutant type 25
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKRQRTRRMMRTKMRMRRMRRTRRKMRRKMSPARPRTSCREACLQGWTEA

SEQ ID NO: 245 - DNA, 5890 bp, Homo sapiens
  Nucleotide sequence encoding Homo sapiens calreticulin mutant type 26
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagacaaaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 246 - DNA, 1287 bp, Homo sapiens
  Nucleotide sequence encoding Homo sapiens calreticulin mutant type 26
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaaaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 247 - RNA, 1287 nt, Homo sapiens
  Nucleotide sequence encoding Homo sapiens calreticulin mutant type 26
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaaggaggaggaagaagacaaaaacgcaaagaggaggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 248 - protein, 428 aa, Homo sapiens
  Amino acid sequence of Homo sapiens calreticulin mutant type 26
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKNAKRRRRQRTRRMMRTKMRMRRMRRTRRKMRRKMSPARPRTSCREACLQGWTEA

SEQ ID NO: 249 - DNA, 5893 bp, Homo sapiens
  Nucleotide sequence encoding Homo sapiens calreticulin mutant type 27
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagacaagtgtttcgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 250 - DNA, 1290 bp, Homo sapiens
  Nucleotide sequence encoding Homo sapiens calreticulin mutant type 27
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagtgtttcgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 251 - RNA, 1290 nt, Homo sapiens
  Nucleotide sequence encoding Homo sapiens calreticulin mutant type 27
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaaggaggaggaagaagacaaguguuucgcaaagaggaggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 252 - protein, 429 aa, Homo sapiens
  Amino acid sequence of Homo sapiens calreticulin mutant type 27
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKCFAKRRRRQRTRRMMRTKMRMRRMRRTRRKMRRKMSPARPRTSCREACLQGWTEA

SEQ ID NO: 253 - DNA, 5869 bp, Homo sapiens
  Nucleotide sequence encoding Homo sapiens calreticulin mutant type 28
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagacaagaaacgcaaaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 254 - DNA, 1266 bp, Homo sapiens
  Nucleotide sequence encoding Homo sapiens calreticulin mutant type 28
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 255 - RNA, 1266 nt, Homo sapiens
  Nucleotide sequence encoding Homo sapiens calreticulin mutant type 28
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaaggaggaggaagaagacaagaaacgcaaaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 256 - protein, 421 aa, Homo sapiens
  Amino acid sequence of Homo sapiens calreticulin mutant type 28
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKRRMMRTKMRMRRMRRTRRKMRRKMSPARPRTSCREACLQGWTEA

SEQ ID NO: 257 - DNA, 5887 bp, Homo sapiens
  Nucleotide sequence encoding Homo sapiens calreticulin mutant type 29
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagacaagaaacgcaaagagcctcctctttgtctaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 258 - DNA, 1284 bp, Homo sapiens
  Nucleotide sequence encoding Homo sapiens calreticulin mutant type 29
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagagcctcctctttgtctaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 259 - RNA, 1284 nt, Homo sapiens
  Nucleotide sequence encoding Homo sapiens calreticulin mutant type 29
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaaggaggaggaagaagacaagaaacgcaaagagccuccucuuugucuaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 260 - protein, 427 aa, Homo sapiens
  Amino acid sequence of Homo sapiens calreticulin mutant type 29
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEPPLCLRRMMRTKMRMRRMRRTRRKMRRKMSPARPRTSCREACLQGWTEA

SEQ ID NO: 261 - DNA, 5884 bp, Homo sapiens
  Nucleotide sequence encoding Homo sapiens calreticulin mutant type 30
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagacaagaaacgcaaagaggaccatccttgtcggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 262 - DNA, 1281 bp, Homo sapiens
  Nucleotide sequence encoding Homo sapiens calreticulin mutant type 30
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaccatccttgtcggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 263 - RNA, 1281 nt, Homo sapiens
  Nucleotide sequence encoding Homo sapiens calreticulin mutant type 30
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaaggaggaggaagaagacaagaaacgcaaagaggaccauccuugucggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 264 - protein, 426 aa, Homo sapiens
  Amino acid sequence of Homo sapiens calreticulin mutant type 30
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEDHPCRRMMRTKMRMRRMRRTRRKMRRKMSPARPRTSCREACLQGWTEA

SEQ ID NO: 265 - DNA, 5896 bp, Homo sapiens
  Nucleotide sequence encoding Homo sapiens calreticulin mutant type 31
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagacaagaaacgcaaagaggaggaggaggcagagggcaattgtcggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 266 - DNA, 1293 bp, Homo sapiens
  Nucleotide sequence encoding Homo sapiens calreticulin mutant type 31
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagagggcaattgtcggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 267 - RNA, 1293 nt, Homo sapiens
  Nucleotide sequence encoding Homo sapiens calreticulin mutant type 31
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaaggaggaggaagaagacaagaaacgcaaagaggaggaggaggcagagggcaauugucggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 268 - protein, 430 aa, Homo sapiens
  Amino acid sequence of Homo sapiens calreticulin mutant type 31
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEGNCRRMMRTKMRMRRMRRTRRKMRRKMSPARPRTSCREACLQGWTEA

SEQ ID NO: 269 - DNA, 5893 bp, Homo sapiens
  Nucleotide sequence encoding Homo sapiens calreticulin mutant type 32
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagacaagaaacgcaaagaggaggaggaggcagaggactgtcggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 270 - DNA, 1290 bp, Homo sapiens
  Nucleotide sequence encoding Homo sapiens calreticulin mutant type 32
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggactgtcggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 271 - RNA, 1290 nt, Homo sapiens
  Nucleotide sequence encoding Homo sapiens calreticulin mutant type 32
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaaggaggaggaagaagacaagaaacgcaaagaggaggaggaggcagaggacugucggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 272 - protein, 429 aa, Homo sapiens
  Amino acid sequence of Homo sapiens calreticulin mutant type 32
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDCRRMMRTKMRMRRMRRTRRKMRRKMSPARPRTSCREACLQGWTEA

SEQ ID NO: 273 - DNA, 5896 bp, Homo sapiens
  Nucleotide sequence encoding Homo sapiens calreticulin mutant type 33
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagacaagaaacgcaaagaggaggaggaggcagaggacaaatgtcggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 274 - DNA, 1293 bp, Homo sapiens
  Nucleotide sequence encoding Homo sapiens calreticulin mutant type 33
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaatgtcggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 275 - RNA, 1293 nt, Homo sapiens
  Nucleotide sequence encoding Homo sapiens calreticulin mutant type 33
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaaggaggaggaagaagacaagaaacgcaaagaggaggaggaggcagaggacaaaugucggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 276 - protein, 430 aa, Homo sapiens
  Amino acid sequence of Homo sapiens calreticulin mutant type 33
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDKCRRMMRTKMRMRRMRRTRRKMRRKMSPARPRTSCREACLQGWTEA

SEQ ID NO: 277 - DNA, 5896 bp, Homo sapiens
  Nucleotide sequence encoding Homo sapiens calreticulin mutant type 34
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagacaagaaacgcaaagaggaggaggaggcagaggacacttgtcggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 278 - DNA, 1293 bp, Homo sapiens
  Nucleotide sequence encoding Homo sapiens calreticulin mutant type 34
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacacttgtcggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 279 - RNA, 1293 nt, Homo sapiens
  Nucleotide sequence encoding Homo sapiens calreticulin mutant type 34
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaaggaggaggaagaagacaagaaacgcaaagaggaggaggaggcagaggacacuugucggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 280 - protein, 430 aa, Homo sapiens
  Amino acid sequence of Homo sapiens calreticulin mutant type 34
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDTCRRMMRTKMRMRRMRRTRRKMRRKMSPARPRTSCREACLQGWTEA

SEQ ID NO: 281 - DNA, 5896 bp, Homo sapiens
  Nucleotide sequence encoding Homo sapiens calreticulin mutant type 35
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagacaagaaacgcaaagaggaggaggaggcagaggacatttgtcggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 282 - DNA, 1293 bp, Homo sapiens
  Nucleotide sequence encoding Homo sapiens calreticulin mutant type 35
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacatttgtcggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 283 - RNA, 1293 nt, Homo sapiens
  Nucleotide sequence encoding Homo sapiens calreticulin mutant type 35
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaaggaggaggaagaagacaagaaacgcaaagaggaggaggaggcagaggacauuugucggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 284 - protein, 430 aa, Homo sapiens [sequence omitted]

SEQ ID NO: 285 - DNA, 5896 bp, Homo sapiens
  Nucleotide sequence encoding Homo sapiens calreticulin mutant type 36
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagacaagaaacgcaaagaggaggaggaggcagaggacaagtgtcggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 286 - DNA, 1293 bp, Homo sapiens
  Nucleotide sequence encoding Homo sapiens calreticulin mutant type 36
atgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaagtgtcggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 287 - RNA, 1293 nt, Homo sapiens
  Nucleotide sequence encoding Homo sapiens calreticulin mutant type 36
augcugcuauccgugccgcugcugcucggccuccucggccuggccgucgccgagccugccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaaggaggaggaagaagacaagaaacgcaaagaggaggaggaggcagaggacaagugucggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 288 - protein, 430 aa, Homo sapiens; identical to SEQ ID NO: 276
  Amino acid sequence of Homo sapiens calreticulin mutant type 36

SEQ ID NO: 289 - DNA, 5891 bp, Homo sapiens
  Nucleotide sequence encoding Homo sapiens calreticulin wild type
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 290 - protein, 417 aa, Homo sapiens
  Amino acid sequence of Homo sapiens calreticulin wild type
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDKEDDEDKDEDEEDEEDKEEDEEEDVPGQAKDEL

SEQ ID NO: 291 - DNA, 726 bp, Homo sapiens
  Nucleotide sequence encoding Homo sapiens calreticulin exon 9 mutant type 1
gcagcagagaaacaaatgaaggacaaacaggacgaggagcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 292 - DNA, 183 bp, Homo sapiens
  Nucleotide sequence encoding Homo sapiens calreticulin exon 9 mutant type 1
gcagcagagaaacaaatgaaggacaaacaggacgaggagcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 293 - RNA, 183 nt, Homo sapiens
  Nucleotide sequence encoding Homo sapiens calreticulin exon 9 mutant type 1
gcagcagagaaacaaaugaaggacaaacaggacgaggagcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 294 - protein, 60 aa, Homo sapiens
  Amino acid sequence of Homo sapiens calreticulin exon 9 mutant type 1
AAEKQMKDKQDEEQRTRRMMRTKMRMRRMRRTRRKMRRKMSPARPRTSCREACLQGWTEA

SEQ ID NO: 295 - DNA, 783 bp, Homo sapiens
  Nucleotide sequence encoding Homo sapiens calreticulin exon 9 mutant type 2
gcagcagagaaacaaatgaaggacaaacaggacgaggagcagaggcttaaggaggaggaagaagacaagaaacgcaaagaggaggaggaggcagaggacaattgtcggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 296 - DNA, 240 bp, Homo sapiens
  Nucleotide sequence encoding Homo sapiens calreticulin exon 9 mutant type 2
gcagcagagaaacaaatgaaggacaaacaggacgaggagcagaggcttaaggaggaggaagaagacaagaaacgcaaagaggaggaggaggcagaggacaattgtcggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 297 - RNA, 240 nt, Homo sapiens
  Nucleotide sequence encoding Homo sapiens calreticulin exon 9 mutant type 2
gcagcagagaaacaaaugaaggacaaacaggacgaggagcagaggcuuaaggaggaggaagaagacaagaaacgcaaagaggaggaggaggcagaggacaauugucggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 298 - protein, 79 aa, Homo sapiens
  Amino acid sequence of Homo sapiens calreticulin exon 9 mutant type 2
AAEKQMKDKQDEEQRLKEEEEDKKRKEEEEAEDNCRRMMRTKMRMRRMRRTRRKMRRKMSPARPRTSCREACLQGWTEA

SEQ ID NO: 299 - DNA, 732 bp, Homo sapiens
  Nucleotide sequence encoding Homo sapiens calreticulin exon 9 mutant type 3
gcagcagagaaacaaatgaaggacaaacaggacgaggagcagaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 300 - DNA, 189 bp, Homo sapiens
  Nucleotide sequence encoding Homo sapiens calreticulin exon 9 mutant type 3
gcagcagagaaacaaatgaaggacaaacaggacgaggagcagaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 301 - RNA, 189 nt, Homo sapiens
  Nucleotide sequence encoding Homo sapiens calreticulin exon 9 mutant type 3
gcagcagagaaacaaaugaaggacaaacaggacgaggagcagaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 302 - protein, 62 aa, Homo sapiens
  Amino acid sequence of Homo sapiens calreticulin exon 9 mutant type 3
AAEKQMKDKQDEEQRQRTRRMMRTKMRMRRMRRTRRKMRRKMSPARPRTSCREACLQGWTEA

SEQ ID NO: 303 - DNA, 744 bp, Homo sapiens
  Nucleotide sequence encoding Homo sapiens calreticulin exon 9 mutant type 4
gcagcagagaaacaaatgaaggacaaacaggacgaggagcagaggcttaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 304 - DNA, 201 bp, Homo sapiens
  Nucleotide sequence encoding Homo sapiens calreticulin exon 9 mutant type 4
gcagcagagaaacaaatgaaggacaaacaggacgaggagcagaggcttaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 305 - RNA, 201 nt, Homo sapiens
  Nucleotide sequence encoding Homo sapiens calreticulin exon 9 mutant type 4
gcagcagagaaacaaaugaaggacaaacaggacgaggagcagaggcuuaggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 306 - protein, 66 aa, Homo sapiens
  Amino acid sequence of Homo sapiens calreticulin exon 9 mutant type 4
AAEKQMKDKQDEEQRLRRRQRTRRMMRTKMRMRRMRRTRRKMRRKMSPARPRTSCREACLQGWTEA

SEQ ID NO: 307 - DNA, 726 bp, Homo sapiens
  Nucleotide sequence encoding Homo sapiens calreticulin exon 9 mutant type 5
gcagcagagaaacaaatgaaggacaaacaggacgaggggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 308 - DNA, 183 bp, Homo sapiens
  Nucleotide sequence encoding Homo sapiens calreticulin exon 9 mutant type 5
gcagcagagaaacaaatgaaggacaaacaggacgaggggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 309 - RNA, 183 nt, Homo sapiens
  Nucleotide sequence encoding Homo sapiens calreticulin exon 9 mutant type 5
gcagcagagaaacaaaugaaggacaaacaggacgaggggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 310 - protein, 60 aa, Homo sapiens
  Amino acid sequence of Homo sapiens calreticulin exon 9 mutant type 5
AAEKQMKDKQDEGQRTRRMMRTKMRMRRMRRTRRKMRRKMSPARPRTSCREACLQGWTEA

SEQ ID NO: 311 - DNA, 732 bp, Homo sapiens
  Nucleotide sequence encoding Homo sapiens calreticulin exon 9 mutant type 6
gcagcagagaaacaaatgaaggacaaacaggacgaggagcggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 312 - DNA, 189 bp, Homo sapiens
  Nucleotide sequence encoding Homo sapiens calreticulin exon 9 mutant type 6
gcagcagagaaacaaatgaaggacaaacaggacgaggagcggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 313 - RNA, 189 nt, Homo sapiens
  Nucleotide sequence encoding Homo sapiens calreticulin exon 9 mutant type 6
gcagcagagaaacaaaugaaggacaaacaggacgaggagcggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 314 - protein, 62 aa, Homo sapiens
  Amino acid sequence of Homo sapiens calreticulin exon 9 mutant type 6
AAEKQMKDKQDEERRQRTRRMMRTKMRMRRMRRTRRKMRRKMSPARPRTSCREACLQGWTEA

SEQ ID NO: 315 - DNA, 726 bp, Homo sapiens
  Nucleotide sequence encoding Homo sapiens calreticulin exon 9 mutant type 7
gcagcagagaaacaaatgaaggacaaacaggacgaggagcagaggcttaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 316 - DNA, 183 bp, Homo sapiens
  Nucleotide sequence encoding Homo sapiens calreticulin exon 9 mutant type 7
gcagcagagaaacaaatgaaggacaaacaggacgaggagcagaggcttaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 317 - RNA, 183 nt, Homo sapiens
  Nucleotide sequence encoding Homo sapiens calreticulin exon 9 mutant type 7
gcagcagagaaacaaaugaaggacaaacaggacgaggagcagaggcuuaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 318 - protein, 60 aa, Homo sapiens
  Amino acid sequence of Homo sapiens calreticulin exon 9 mutant type 7
AAEKQMKDKQDEEQRLRRMMRTKMRMRRMRRTRRKMRRKMSPARPRTSCREACLQGWTEA

SEQ ID NO: 319 - DNA, 744 bp, Homo sapiens
  Nucleotide sequence encoding Homo sapiens calreticulin exon 9 mutant type 8
gcagcagagaaacaaatgaaggacaaacaggacgaggagcagaggcttaagaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 320 - DNA, 201 bp, Homo sapiens
  Nucleotide sequence encoding Homo sapiens calreticulin exon 9 mutant type 8
gcagcagagaaacaaatgaaggacaaacaggacgaggagcagaggcttaagaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 321 - RNA, 201 nt, Homo sapiens
  Nucleotide sequence encoding Homo sapiens calreticulin exon 9 mutant type 8
gcagcagagaaacaaaugaaggacaaacaggacgaggagcagaggcuuaagaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 322 - protein, 66 aa, Homo sapiens
  Amino acid sequence of Homo sapiens calreticulin exon 9 mutant type 8
AAEKQMKDKQDEEQRLKRRQRTRRMMRTKMRMRRMRRTRRKMRRKMSPARPRTSCREACLQGWTEA

SEQ ID NO: 323 - DNA, 777 bp, Homo sapiens
  Nucleotide sequence encoding Homo sapiens calreticulin exon 9 mutant type 9
gcagcagagaaacaaatgaaggacaaacaggacgaggagcagaggcttaaggaggaggaagaagacaagaaacgcaaagaggaggagaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 324 - DNA, 234 bp, Homo sapiens
  Nucleotide sequence encoding Homo sapiens calreticulin exon 9 mutant type 9
gcagcagagaaacaaatgaaggacaaacaggacgaggagcagaggcttaaggaggaggaagaagacaagaaacgcaaagaggaggagaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 325 - RNA, 234 nt, Homo sapiens
  Nucleotide sequence encoding Homo sapiens calreticulin exon 9 mutant type 9
gcagcagagaaacaaaugaaggacaaacaggacgaggagcagaggcuuaaggaggaggaagaagacaagaaacgcaaagaggaggagaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 326 - protein, 77 aa, Homo sapiens
  Amino acid sequence of Homo sapiens calreticulin exon 9 mutant type 9
AAEKQMKDKQDEEQRLKEEEEDKKRKEEERQRTRRMMRTKMRMRRMRRTRRKMRRKMSPARPRTSCREACLQGWTEA

SEQ ID NO: 327 - DNA, 783 bp, Homo sapiens
  Nucleotide sequence encoding Homo sapiens calreticulin exon 9 mutant type 10
gcagcagagaaacaaatgaaggacaaacaggacgaggagcagaggcttaaggaggaggaagaagacaagaaacgcaaagaggaggaggaggcagaggacatgtgtcggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 328 - DNA, 240 bp, Homo sapiens
  Nucleotide sequence encoding Homo sapiens calreticulin exon 9 mutant type 10
gcagcagagaaacaaatgaaggacaaacaggacgaggagcagaggcttaaggaggaggaagaagacaagaaacgcaaagaggaggaggaggcagaggacatgtgtcggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 329 - RNA, 240 nt, Homo sapiens
  Nucleotide sequence encoding Homo sapiens calreticulin exon 9 mutant type 10
gcagcagagaaacaaaugaaggacaaacaggacgaggagcagaggcuuaaggaggaggaagaagacaagaaacgcaaagaggaggaggaggcagaggacaugugucggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 330 - protein, 79 aa, Homo sapiens
  Amino acid sequence of Homo sapiens calreticulin exon 9 mutant type 10
AAEKQMKDKQDEEQRLKEEEEDKKRKEEEEAEDMCRRMMRTKMRMRRMRRTRRKMRRKMSPARPRTSCREACLQGWTEA

SEQ ID NO: 331 - DNA, 732 bp, Homo sapiens
  Nucleotide sequence encoding Homo sapiens calreticulin exon 9 mutant type 11
gcagcagagaaacaaatgaaggacaaacaggacgaggaccagaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 332 - DNA, 189 bp, Homo sapiens
  Nucleotide sequence encoding Homo sapiens calreticulin exon 9 mutant type 11
gcagcagagaaacaaatgaaggacaaacaggacgaggaccagaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 333 - RNA, 189 nt, Homo sapiens
  Nucleotide sequence encoding Homo sapiens calreticulin exon 9 mutant type 11
gcagcagagaaacaaaugaaggacaaacaggacgaggaccagaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 334 - protein, 62 aa, Homo sapiens
  Amino acid sequence of Homo sapiens calreticulin exon 9 mutant type 11
AAEKQMKDKQDEDQRQRTRRMMRTKMRMRRMRRTRRKMRRKMSPARPRTSCREACLQGWTEA

SEQ ID NO: 335 - DNA, 744 bp, Homo sapiens
  Nucleotide sequence encoding Homo sapiens calreticulin exon 9 mutant type 12
gcagcagagaaacaaatgaaggacaaacaggacgaggagcagaggaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 336 - DNA, 201 bp, Homo sapiens
  Nucleotide sequence encoding Homo sapiens calreticulin exon 9 mutant type 12
gcagcagagaaacaaatgaaggacaaacaggacgaggagcagaggaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 337 - RNA, 201 nt, Homo sapiens
  Nucleotide sequence encoding Homo sapiens calreticulin exon 9 mutant type 12
gcagcagagaaacaaaugaaggacaaacaggacgaggagcagaggaggaggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 338 - protein, 66 aa, Homo sapiens
  Amino acid sequence of Homo sapiens calreticulin exon 9 mutant type 12
AAEKQMKDKQDEEQRRRRRQRTRRMMRTKMRMRRMRRTRRKMRRKMSPARPRTSCREACLQGWTEA

SEQ ID NO: 339 - DNA, 744 bp, Homo sapiens
  Nucleotide sequence encoding Homo sapiens calreticulin exon 9 mutant type 13
gcagcagagaaacaaatgaaggacaaacaggacgaggagcagaggcagaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 340 - DNA, 201 bp, Homo sapiens
  Nucleotide sequence encoding Homo sapiens calreticulin exon 9 mutant type 13
gcagcagagaaacaaatgaaggacaaacaggacgaggagcagaggcagaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 341 - RNA, 201 nt, Homo sapiens
  Nucleotide sequence encoding Homo sapiens calreticulin exon 9 mutant type 13
gcagcagagaaacaaaugaaggacaaacaggacgaggagcagaggcagaggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 342 - protein, 66 aa, Homo sapiens
  Amino acid sequence of Homo sapiens calreticulin exon 9 mutant type 13
AAEKQMKDKQDEEQRQRRRQRTRRMMRTKMRMRRMRRTRRKMRRKMSPARPRTSCREACLQGWTEA

SEQ ID NO: 343 - DNA, 744 bp, Homo sapiens
  Nucleotide sequence encoding Homo sapiens calreticulin exon 9 mutant type 14
gcagcagagaaacaaatgaaggacaaacaggacgaggagcagaggctgaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 344 - DNA, 201 bp, Homo sapiens
  Nucleotide sequence encoding Homo sapiens calreticulin exon 9 mutant type 14
gcagcagagaaacaaatgaaggacaaacaggacgaggagcagaggctgaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 345 - RNA, 201 nt, Homo sapiens
  Nucleotide sequence encoding Homo sapiens calreticulin exon 9 mutant type 14
gcagcagagaaacaaaugaaggacaaacaggacgaggagcagaggcugaggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 346 - protein, 66 aa, Homo sapiens; identical to SEQ ID NO: 306
  Amino acid sequence of Homo sapiens calreticulin exon 9 mutant type 14

SEQ ID NO: 347 - DNA, 744 bp, Homo sapiens
  Nucleotide sequence encoding Homo sapiens calreticulin exon 9 mutant type 15
gcagcagagaaacaaatgaaggacaaacaggacgaggagcagaggcttaggaggagggagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 348 - DNA, 201 bp, Homo sapiens
  Nucleotide sequence encoding Homo sapiens calreticulin exon 9 mutant type 15
gcagcagagaaacaaatgaaggacaaacaggacgaggagcagaggcttaggaggagggagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 349 - RNA, 201 nt, Homo sapiens
  Nucleotide sequence encoding Homo sapiens calreticulin exon 9 mutant type 15
gcagcagagaaacaaaugaaggacaaacaggacgaggagcagaggcuuaggaggagggagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 350 - protein, 66 aa, Homo sapiens
  Amino acid sequence of Homo sapiens calreticulin exon 9 mutant type 15
AAEKQMKDKQDEEQRLRRRERTRRMMRTKMRMRRMRRTRRKMRRKMSPARPRTSCREACLQGWTEA

SEQ ID NO: 351 - DNA, 744 bp, Homo sapiens
  Nucleotide sequence encoding Homo sapiens calreticulin exon 9 mutant type 16
gcagcagagaaacaaatgaaggacaaacaggacgaggagcagaggcttcagaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 352 - DNA, 235 bp, Homo sapiens
  Nucleotide sequence encoding Homo sapiens calreticulin exon 9 mutant type 16
gcagcagagaaacaaatgaaggacaaacaggacgaggagcagaggcttcagaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgaagaggcctgcctccagggctggactgaggcctga

SEQ ID NO: 353 - RNA, 235 nt, Homo sapiens
  Nucleotide sequence encoding Homo sapiens calreticulin exon 9 mutant type 16
gcagcagagaaacaaaugaaggacaaacaggacgaggagcagaggcuucagaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccugaagaggccugccuccagggcuggacugaggccuga

SEQ ID NO: 354 - protein, 66 aa, Homo sapiens
  Amino acid sequence of Homo sapiens calreticulin exon 9 mutant type 16
AAEKQMKDKQDEEQRLQRRQRTRRMMRTKMRMRRMRRTRRKMRRKMSPARPRTSCREACLQGWTEA

SEQ ID NO: 355 - DNA, 744 bp, Homo sapiens
  Nucleotide sequence encoding Homo sapiens calreticulin exon 9 mutant type 17
gcagcagagaaacaaatgaaggacaaacaggacgaggagcagaggcttaagaggaggcagtggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 356 - DNA, 201 bp, Homo sapiens
  Nucleotide sequence encoding Homo sapiens calreticulin exon 9 mutant type 17
gcagcagagaaacaaatgaaggacaaacaggacgaggagcagaggcttaagaggaggcagtggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 357 - RNA, 201 nt, Homo sapiens
  Nucleotide sequence encoding Homo sapiens calreticulin exon 9 mutant type 17
gcagcagagaaacaaaugaaggacaaacaggacgaggagcagaggcuuaagaggaggcaguggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 358 - protein, 66 aa, Homo sapiens
  Amino acid sequence of Homo sapiens calreticulin exon 9 mutant type 17
AAEKQMKDKQDEEQRLKRRQWTRRMMRTKMRMRRMRRTRRKMRRKMSPARPRTSCREACLQGWTEA

SEQ ID NO: 359 - DNA, 726 bp, Homo sapiens
  Nucleotide sequence encoding Homo sapiens calreticulin exon 9 mutant type 18
gcagcagagaaacaaatgaaggacaaacaggacgaggagcagaggcttaagaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 360 - DNA, 183 bp, Homo sapiens
  Nucleotide sequence encoding Homo sapiens calreticulin exon 9 mutant type 18
gcagcagagaaacaaatgaaggacaaacaggacgaggagcagaggcttaagaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 361 - RNA, 183 nt, Homo sapiens
  Nucleotide sequence encoding Homo sapiens calreticulin exon 9 mutant type 18
gcagcagagaaacaaaugaaggacaaacaggacgaggagcagaggcuuaagaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 362 - protein, 60 aa, Homo sapiens
  Amino acid sequence of Homo sapiens calreticulin exon 9 mutant type 18
AAEKQMKDKQDEEQRLKRMMRTKMRMRRMRRTRRKMRRKMSPARPRTSCREACLQGWTEA

SEQ ID NO: 363 - DNA, 747 bp, Homo sapiens
  Nucleotide sequence encoding Homo sapiens calreticulin exon 9 mutant type 19
gcagcagagaaacaaatgaaggacaaacaggacgaggagcagaggcttaaggaggagaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 364 - DNA, 204 bp, Homo sapiens
  Nucleotide sequence encoding Homo sapiens calreticulin exon 9 mutant type 19
gcagcagagaaacaaatgaaggacaaacaggacgaggagcagaggcttaaggaggagaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 365 - RNA, 204 nt, Homo sapiens
  Nucleotide sequence encoding Homo sapiens calreticulin exon 9 mutant type 19
gcagcagagaaacaaaugaaggacaaacaggacgaggagcagaggcuuaaggaggagaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 366 - protein, 67 aa, Homo sapiens
  Amino acid sequence of Homo sapiens calreticulin exon 9 mutant type 19
AAEKQMKDKQDEEQRLKEERQRTRRMMRTKMRMRRMRRTRRKMRRKMSPARPRTSCREACLQGWTEA

SEQ ID NO: 367 - DNA, 759 bp, Homo sapiens
  Nucleotide sequence encoding Homo sapiens calreticulin exon 9 mutant type 20
gcagcagagaaacaaatgaaggacaaacaggacgaggagcagaggcttaaggaggaggaagaagggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 368 - DNA, 216 bp, Homo sapiens
  Nucleotide sequence encoding Homo sapiens calreticulin exon 9 mutant type 20
gcagcagagaaacaaatgaaggacaaacaggacgaggagcagaggcttaaggaggaggaagaagggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 369 - RNA, 216 nt, Homo sapiens
  Nucleotide sequence encoding Homo sapiens calreticulin exon 9 mutant type 20
gcagcagagaaacaaaugaaggacaaacaggacgaggagcagaggcuuaaggaggaggaagaagggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 370 - protein, 71 aa, Homo sapiens
  Amino acid sequence of Homo sapiens calreticulin exon 9 mutant type 20
AAEKQMKDKQDEEQRLKEEEEGRRQRTRRMMRTKMRMRRMRRTRRKMRRKMSPARPRTSCREACLQGWTEA

SEQ ID NO: 371 - DNA, 756 bp, Homo sapiens
  Nucleotide sequence encoding Homo sapiens calreticulin exon 9 mutant type 21
gcagcagagaaacaaatgaaggacaaacaggacgaggagcagaggcttaaggaggaggaagaagcgtttaagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 372 - DNA, 213 bp, Homo sapiens
  Nucleotide sequence encoding Homo sapiens calreticulin exon 9 mutant type 21
gcagcagagaaacaaatgaaggacaaacaggacgaggagcagaggcttaaggaggaggaagaagcgtttaagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 373 - RNA, 213 nt, Homo sapiens
  Nucleotide sequence encoding Homo sapiens calreticulin exon 9 mutant type 21
gcagcagagaaacaaaugaaggacaaacaggacgaggagcagaggcuuaaggaggaggaagaagcguuuaagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 374 - protein, 70 aa, Homo sapiens
  Amino acid sequence of Homo sapiens calreticulin exon 9 mutant type 21
AAEKQMKDKQDEEQRLKEEEEAFKRTRRMMRTKMRMRRMRRTRRKMRRKMSPARPRTSCREACLQGWTEA

SEQ ID NO: 375 - DNA, 774 bp, Homo sapiens
  Nucleotide sequence encoding Homo sapiens calreticulin exon 9 mutant type 22
gcagcagagaaacaaatgaaggacaaacaggacgaggagcagaggcttaaggaggaggaagaagacaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 376 - DNA, 231 bp, Homo sapiens
  Nucleotide sequence encoding Homo sapiens calreticulin exon 9 mutant type 22
gcagcagagaaacaaatgaaggacaaacaggacgaggagcagaggcttaaggaggaggaagaagacaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 377 - RNA, 231 nt, Homo sapiens
  Nucleotide sequence encoding Homo sapiens calreticulin exon 9 mutant type 22
gcagcagagaaacaaaugaaggacaaacaggacgaggagcagaggcuuaaggaggaggaagaagacaacgcaaagaggaggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 378 - protein, 76 aa, Homo sapiens
  Amino acid sequence of Homo sapiens calreticulin exon 9 mutant type 22
AAEKQMKDKQDEEQRLKEEEEDNAKRRRRQRTRRMMRTKMRMRRMRRTRRKMRRKMSPARPRTSCREACLQGWTEA

SEQ ID NO: 379 - DNA, 771 bp, Homo sapiens
  Nucleotide sequence encoding Homo sapiens calreticulin exon 9 mutant type 23
gcagcagagaaacaaatgaaggacaaacaggacgaggagcagaggcttaaggaggaggaagaagactgcgtgaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 380 - DNA, 228 bp, Homo sapiens
  Nucleotide sequence encoding Homo sapiens calreticulin exon 9 mutant type 23
gcagcagagaaacaaatgaaggacaaacaggacgaggagcagaggcttaaggaggaggaagaagactgcgtgaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 381 - RNA, 228 nt, Homo sapiens
  Nucleotide sequence encoding Homo sapiens calreticulin exon 9 mutant type 23
gcagcagagaaacaaaugaaggacaaacaggacgaggagcagaggcuuaaggaggaggaagaagacugcgugaggaggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 382 - protein, 75 aa, Homo sapiens
  Amino acid sequence of Homo sapiens calreticulin exon 9 mutant type 23
AAEKQMKDKQDEEQRLKEEEEDCVRRRRQRTRRMMRTKMRMRRMRRTRRKMRRKMSPARPRTSCREACLQGWTEA

SEQ ID NO: 383 - DNA, 759 bp, Homo sapiens
  Nucleotide sequence encoding Homo sapiens calreticulin exon 9 mutant type 24
gcagcagagaaacaaatgaaggacaaacaggacgaggagcagaggcttaaggaggaggaagaagacaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 384 - DNA, 216 bp, Homo sapiens
  Nucleotide sequence encoding Homo sapiens calreticulin exon 9 mutant type 24
gcagcagagaaacaaatgaaggacaaacaggacgaggagcagaggcttaaggaggaggaagaagacaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 385 - RNA, 216 nt, Homo sapiens
  Nucleotide sequence encoding Homo sapiens calreticulin exon 9 mutant type 24
gcagcagagaaacaaaugaaggacaaacaggacgaggagcagaggcuuaaggaggaggaagaagacaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 386 - protein, 71 aa, Homo sapiens
  Amino acid sequence of Homo sapiens calreticulin exon 9 mutant type 24
AAEKQMKDKQDEEQRLKEEEEDRRQRTRRMMRTKMRMRRMRRTRRKMRRKMSPARPRTSCREACLQGWTEA

SEQ ID NO: 387 - DNA, 759 bp, Homo sapiens
  Nucleotide sequence encoding Homo sapiens calreticulin exon 9 mutant type 25
gcagcagagaaacaaatgaaggacaaacaggacgaggagcagaggcttaaggaggaggaagaagacaaaaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 388 - DNA, 216 bp, Homo sapiens
  Nucleotide sequence encoding Homo sapiens calreticulin exon 9 mutant type 25
gcagcagagaaacaaatgaaggacaaacaggacgaggagcagaggcttaaggaggaggaagaagacaaaaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 389 - RNA, 216 nt, Homo sapiens
  Nucleotide sequence encoding Homo sapiens calreticulin exon 9 mutant type 25
gcagcagagaaacaaaugaaggacaaacaggacgaggagcagaggcuuaaggaggaggaagaagacaaaaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 390 - protein, 71 aa, Homo sapiens
  Amino acid sequence of Homo sapiens calreticulin exon 9 mutant type 25
AAEKQMKDKQDEEQRLKEEEEDKRQRTRRMMRTKMRMRRMRRTRRKMRRKMSPARPRTSCREACLQGWTEA

SEQ ID NO: 391 - DNA, 777 bp, Homo sapiens
  Nucleotide sequence encoding Homo sapiens calreticulin exon 9 mutant type 26
gcagcagagaaacaaatgaaggacaaacaggacgaggagcagaggcttaaggaggaggaagaagacaaaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 392 - DNA, 234 bp, Homo sapiens
  Nucleotide sequence encoding Homo sapiens calreticulin exon 9 mutant type 26
gcagcagagaaacaaatgaaggacaaacaggacgaggagcagaggcttaaggaggaggaagaagacaaaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 393 - RNA, 234 nt, Homo sapiens
  Nucleotide sequence encoding Homo sapiens calreticulin exon 9 mutant type 26
gcagcagagaaacaaaugaaggacaaacaggacgaggagcagaggcuuaaggaggaggaagaagacaaaaacgcaaagaggaggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 394 - protein, 77 aa, Homo sapiens
  Amino acid sequence of Homo sapiens calreticulin exon 9 mutant type 26
AAEKQMKDKQDEEQRLKEEEEDKNAKRRRRQRTRRMMRTKMRMRRMRRTRRKMRRKMSPARPRTSCREACLQGWTEA

SEQ ID NO: 395 - DNA, 780 bp, Homo sapiens
  Nucleotide sequence encoding Homo sapiens calreticulin exon 9 mutant type 27
gcagcagagaaacaaatgaaggacaaacaggacgaggagcagaggcttaaggaggaggaagaagacaagtgtttcgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 396 - DNA, 237 bp, Homo sapiens
  Nucleotide sequence encoding Homo sapiens calreticulin exon 9 mutant type 27
gcagcagagaaacaaatgaaggacaaacaggacgaggagcagaggcttaaggaggaggaagaagacaagtgtttcgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 397 - RNA, 237 nt, Homo sapiens
  Nucleotide sequence encoding Homo sapiens calreticulin exon 9 mutant type 27
gcagcagagaaacaaaugaaggacaaacaggacgaggagcagaggcuuaaggaggaggaagaagacaaguguuucgcaaagaggaggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 398 - protein, 78 aa, Homo sapiens
  Amino acid sequence of Homo sapiens calreticulin exon 9 mutant type 27
AAEKQMKDKQDEEQRLKEEEEDKCFAKRRRRQRTRRMMRTKMRMRRMRRTRRKMRRKMSPARPRTSCREACLQGWTEA

SEQ ID NO: 399 - DNA, 756 bp, Homo sapiens
  Nucleotide sequence encoding Homo sapiens calreticulin exon 9 mutant type 28
gcagcagagaaacaaatgaaggacaaacaggacgaggagcagaggcttaaggaggaggaagaagacaagaaacgcaaaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 400 - DNA, 213 bp, Homo sapiens
  Nucleotide sequence encoding Homo sapiens calreticulin exon 9 mutant type 28
gcagcagagaaacaaatgaaggacaaacaggacgaggagcagaggcttaaggaggaggaagaagacaagaaacgcaaaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 401 - RNA, 213 nt, Homo sapiens
  Nucleotide sequence encoding Homo sapiens calreticulin exon 9 mutant type 28
gcagcagagaaacaaaugaaggacaaacaggacgaggagcagaggcuuaaggaggaggaagaagacaagaaacgcaaaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 402 - protein, 70 aa, Homo sapiens
  Amino acid sequence of Homo sapiens calreticulin exon 9 mutant type 28
AAEKQMKDKQDEEQRLKEEEEDKKRKRRMMRTKMRMRRMRRTRRKMRRKMSPARPRTSCREACLQGWTEA

SEQ ID NO: 403 - DNA, 774 bp, Homo sapiens
  Nucleotide sequence encoding Homo sapiens calreticulin exon 9 mutant type 29
gcagcagagaaacaaatgaaggacaaacaggacgaggagcagaggcttaaggaggaggaagaagacaagaaacgcaaagagcctcctctttgtctaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 404 - DNA, 231 bp, Homo sapiens
  Nucleotide sequence encoding Homo sapiens calreticulin exon 9 mutant type 29
gcagcagagaaacaaatgaaggacaaacaggacgaggagcagaggcttaaggaggaggaagaagacaagaaacgcaaagagcctcctctttgtctaaggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 405 - RNA, 231 nt, Homo sapiens
  Nucleotide sequence encoding Homo sapiens calreticulin exon 9 mutant type 29
gcagcagagaaacaaaugaaggacaaacaggacgaggagcagaggcuuaaggaggaggaagaagacaagaaacgcaaagagccuccucuuugucuaaggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 406 - protein, 76 aa, Homo sapiens
  Amino acid sequence of Homo sapiens calreticulin exon 9 mutant type 29
AAEKQMKDKQDEEQRLKEEEEDKKRKEPPLCLRRMMRTKMRMRRMRRTRRKMRRKMSPARPRTSCREACLQGWTEA

SEQ ID NO: 407 - DNA, 771 bp, Homo sapiens
  Nucleotide sequence encoding Homo sapiens calreticulin exon 9 mutant type 30
gcagcagagaaacaaatgaaggacaaacaggacgaggagcagaggcttaaggaggaggaagaagacaagaaacgcaaagaggaccatccttgtcggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 408 - DNA, 228 bp, Homo sapiens
  Nucleotide sequence encoding Homo sapiens calreticulin exon 9 mutant type 30
gcagcagagaaacaaatgaaggacaaacaggacgaggagcagaggcttaaggaggaggaagaagacaagaaacgcaaagaggaccatccttgtcggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 409 - RNA, 228 nt, Homo sapiens
  Nucleotide sequence encoding Homo sapiens calreticulin exon 9 mutant type 30
gcagcagagaaacaaaugaaggacaaacaggacgaggagcagaggcuuaaggaggaggaagaagacaagaaacgcaaagaggaccauccuugucggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 410 - protein, 75 aa, Homo sapiens
  Amino acid sequence of Homo sapiens calreticulin exon 9 mutant type 30
AAEKQMKDKQDEEQRLKEEEEDKKRKEDHPCRRMMRTKMRMRRMRRTRRKMRRKMSPARPRTSCREACLQGWTEA

SEQ ID NO: 411 - DNA, 783 bp, Homo sapiens
  Nucleotide sequence encoding Homo sapiens calreticulin exon 9 mutant type 31
gcagcagagaaacaaatgaaggacaaacaggacgaggagcagaggcttaaggaggaggaagaagacaagaaacgcaaagaggaggaggaggcagagggcaattgtcggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 412 - DNA, 240 bp, Homo sapiens
  Nucleotide sequence encoding Homo sapiens calreticulin exon 9 mutant type 31
gcagcagagaaacaaatgaaggacaaacaggacgaggagcagaggcttaaggaggaggaagaagacaagaaacgcaaagaggaggaggaggcagagggcaattgtcggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 413 - RNA, 240 nt, Homo sapiens
  Nucleotide sequence encoding Homo sapiens calreticulin exon 9 mutant type 31
gcagcagagaaacaaaugaaggacaaacaggacgaggagcagaggcuuaaggaggaggaagaagacaagaaacgcaaagaggaggaggaggcagagggcaauugucggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 414 - protein, 79 aa, Homo sapiens
  Amino acid sequence of Homo sapiens calreticulin exon 9 mutant type 31
AAEKQMKDKQDEEQRLKEEEEDKKRKEEEEAEGNCRRMMRTKMRMRRMRRTRRKMRRKMSPARPRTSCREACLQGWTEA

SEQ ID NO: 415 - DNA, 780 bp, Homo sapiens
  Nucleotide sequence encoding Homo sapiens calreticulin exon 9 mutant type 32
gcagcagagaaacaaatgaaggacaaacaggacgaggagcagaggcttaaggaggaggaagaagacaagaaacgcaaagaggaggaggaggcagaggactgtcggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 416 - DNA, 237 bp, Homo sapiens
  Nucleotide sequence encoding Homo sapiens calreticulin exon 9 mutant type 32
gcagcagagaaacaaatgaaggacaaacaggacgaggagcagaggcttaaggaggaggaagaagacaagaaacgcaaagaggaggaggaggcagaggactgtcggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 417 - RNA, 237 nt, Homo sapiens
  Nucleotide sequence encoding Homo sapiens calreticulin exon 9 mutant type 32
gcagcagagaaacaaaugaaggacaaacaggacgaggagcagaggcuuaaggaggaggaagaagacaagaaacgcaaagaggaggaggaggcagaggacugucggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 418 - protein, 78 aa, Homo sapiens
  Amino acid sequence of Homo sapiens calreticulin exon 9 mutant type 32
AAEKQMKDKQDEEQRLKEEEEDKKRKEEEEAEDCRRMMRTKMRMRRMRRTRRKMRRKMSPARPRTSCREACLQGWTEA

SEQ ID NO: 419 - DNA, 783 bp, Homo sapiens
  Nucleotide sequence encoding Homo sapiens calreticulin exon 9 mutant type 33
gcagcagagaaacaaatgaaggacaaacaggacgaggagcagaggcttaaggaggaggaagaagacaagaaacgcaaagaggaggaggaggcagaggacaaatgtcggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 420 - DNA, 240 bp, Homo sapiens
  Nucleotide sequence encoding Homo sapiens calreticulin exon 9 mutant type 33
gcagcagagaaacaaatgaaggacaaacaggacgaggagcagaggcttaaggaggaggaagaagacaagaaacgcaaagaggaggaggaggcagaggacaaatgtcggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 421 - RNA, 240 nt, Homo sapiens
  Nucleotide sequence encoding Homo sapiens calreticulin exon 9 mutant type 33
gcagcagagaaacaaaugaaggacaaacaggacgaggagcagaggcuuaaggaggaggaagaagacaagaaacgcaaagaggaggaggaggcagaggacaaaugucggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 422 - protein, 79 aa, Homo sapiens
  Amino acid sequence of Homo sapiens calreticulin exon 9 mutant type 33
AAEKQMKDKQDEEQRLKEEEEDKKRKEEEEAEDKCRRMMRTKMRMRRMRRTRRKMRRKMSPARPRTSCREACLQGWTEA

SEQ ID NO: 423 - DNA, 783 bp, Homo sapiens
  Nucleotide sequence encoding Homo sapiens calreticulin exon 9 mutant type 34
gcagcagagaaacaaatgaaggacaaacaggacgaggagcagaggcttaaggaggaggaagaagacaagaaacgcaaagaggaggaggaggcagaggacacttgtcggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 424 - DNA, 240 bp, Homo sapiens
  Nucleotide sequence encoding Homo sapiens calreticulin exon 9 mutant type 34
gcagcagagaaacaaatgaaggacaaacaggacgaggagcagaggcttaaggaggaggaagaagacaagaaacgcaaagaggaggaggaggcagaggacacttgtcggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 425 - RNA, 240 nt, Homo sapiens
  Nucleotide sequence encoding Homo sapiens calreticulin exon 9 mutant type 34
gcagcagagaaacaaaugaaggacaaacaggacgaggagcagaggcuuaaggaggaggaagaagacaagaaacgcaaagaggaggaggaggcagaggacacuugucggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 426 - protein, 79 aa, Homo sapiens
  Amino acid sequence of Homo sapiens calreticulin exon 9 mutant type 34
AAEKQMKDKQDEEQRLKEEEEDKKRKEEEEAEDTCRRMMRTKMRMRRMRRTRRKMRRKMSPARPRTSCREACLQGWTEA

SEQ ID NO: 427 - DNA, 783 bp, Homo sapiens
  Nucleotide sequence encoding Homo sapiens calreticulin exon 9 mutant type 35
gcagcagagaaacaaatgaaggacaaacaggacgaggagcagaggcttaaggaggaggaagaagacaagaaacgcaaagaggaggaggaggcagaggacatttgtcggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 428 - DNA, 240 bp, Homo sapiens
  Nucleotide sequence encoding Homo sapiens calreticulin exon 9 mutant type 35
gcagcagagaaacaaatgaaggacaaacaggacgaggagcagaggcttaaggaggaggaagaagacaagaaacgcaaagaggaggaggaggcagaggacatttgtcggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 429 - RNA, 240 nt, Homo sapiens
  Nucleotide sequence encoding Homo sapiens calreticulin exon 9 mutant type 35
gcagcagagaaacaaaugaaggacaaacaggacgaggagcagaggcuuaaggaggaggaagaagacaagaaacgcaaagaggaggaggaggcagaggacauuugucggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 430 - protein, 79 aa, Homo sapiens
  Amino acid sequence of Homo sapiens calreticulin exon 9 mutant type 35
AAEKQMKDKQDEEQRLKEEEEDKKRKEEEEAEDICRRMMRTKMRMRRMRRTRRKMRRKMSPARPRTSCREACLQGWTEA

SEQ ID NO: 431 - DNA, 783 bp, Homo sapiens
  Nucleotide sequence encoding Homo sapiens calreticulin exon 9 mutant type 36
gcagcagagaaacaaatgaaggacaaacaggacgaggagcagaggcttaaggaggaggaagaagacaagaaacgcaaagaggaggaggaggcagaggacaagtgtcggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 432 - DNA, 240 bp, Homo sapiens
  Nucleotide sequence encoding Homo sapiens calreticulin exon 9 mutant type 36
gcagcagagaaacaaatgaaggacaaacaggacgaggagcagaggcttaaggaggaggaagaagacaagaaacgcaaagaggaggaggaggcagaggacaagtgtcggaggatgatgaggacaaagatgaggatgaggaggatgaggaggacaaggaggaagatgaggaggaagatgtccccggccaggccaaggacgagctgtagagaggcctgcctccagggctggactgaggcctga

SEQ ID NO: 433 - RNA, 240 nt, Homo sapiens
  Nucleotide sequence encoding Homo sapiens calreticulin exon 9 mutant type 36
gcagcagagaaacaaaugaaggacaaacaggacgaggagcagaggcuuaaggaggaggaagaagacaagaaacgcaaagaggaggaggaggcagaggacaagugucggaggaugaugaggacaaagaugaggaugaggaggaugaggaggacaaggaggaagaugaggaggaagauguccccggccaggccaaggacgagcuguagagaggccugccuccagggcuggacugaggccuga

SEQ ID NO: 434 - protein, 79 aa, Homo sapiens; identical to SEQ ID NO: 422
  Amino acid sequence of Homo sapiens calreticulin exon 9 mutant type 36

SEQ ID NO: 435 - DNA, 778 bp, Homo sapiens
  Nucleotide sequence encoding Homo sapiens calreticulin exon 9 wild type
gcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 436 - protein, 66 aa, Homo sapiens
  Amino acid sequence of Homo sapiens calreticulin exon 9 wild type
AAEKQMKDKQDEEQRLKEEEEDKKRKEEEEAEDKEDDEDKDEDEEDEEDKEEDEEEDVPGQAKDEL

SEQ ID NO: 437 - DNA, 21 bp, Artificial Sequence
  Description of Artificial Sequence: Synthetic forward primer
acaacttcctcatcaccaacg

SEQ ID NO: 438 - DNA, 18 bp, Artificial Sequence
  Description of Artificial Sequence: Synthetic reverse primer
ggcctcagtccagccctg

SEQ ID NO: 439 - DNA, 18 bp, Artificial Sequence
  Description of Artificial Sequence: Synthetic forward primer
ggcaaggccctgaggtgt

SEQ ID NO: 440 - DNA, 42 bp, Homo sapiens
gaaggacaaacaggacgaggagcagaggacaaggaggatgat

SEQ ID NO: 441 - DNA, 45 bp, Homo sapiens
gaggaggaggcagaggacaattgtcggaggatgatgaggacaaag

SEQ ID NO: 442 - DNA, 42 bp, Homo sapiens
ggacaaacaggacgaggagcagaggcagaggacaaggaggat

SEQ ID NO: 443 - DNA, 42 bp, Homo sapiens
caggacgaggagcagaggcttaggaggaggcagaggacaagg

SEQ ID NO: 444 - DNA, 42 bp, Homo sapiens
tgaaggacaaacaggacgaggggcagaggacaaggaggatga

SEQ ID NO: 445 - DNA, 42 bp, Homo sapiens
aggacaaacaggacgaggagcggaggcagaggacaaggagga

SEQ ID NO: 446 - DNA, 42 bp, Homo sapiens
caggacgaggagcagaggcttaggaggatgatgaggacaaag

SEQ ID NO: 447 - DNA, 42 bp, Homo sapiens
ggacgaggagcagaggcttaagaggaggcagaggacaaggag

SEQ ID NO: 448 - DNA, 42 bp, Homo sapiens
caagaaacgcaaagaggaggagaggcagaggacaaggaggat

SEQ ID NO: 449 - DNA, 47 bp, Homo sapiens
aggaggaggaggcagaggacatgtgtcggaggatgatgaggacaaag

SEQ ID NO: 450 - DNA, 44 bp, Homo sapiens
aaggacaaacaggacgaggaccagaggcagaggacaaggaggat

SEQ ID NO: 451 - DNA, 42 bp, Homo sapiens
caaacaggacgaggagcagaggaggaggaggaggcagaggac

SEQ ID NO: 452 - DNA, 43 bp, Homo sapiens
aacaggacgaggagcagaggcagaggaggaggcagaggacaag

SEQ ID NO: 453 - DNA, 42 bp, Homo sapiens
acaggacgaggagcagaggctgaggaggaggcagaggacaag

SEQ ID NO: 454 - DNA, 51 bp, Homo sapiens
caggacgaggagcagaggcttaggaggagggagaggacaaggaggatgatg

SEQ ID NO: 455 - DNA, 44 bp, Homo sapiens
caggacgaggagcagaggcttcagaggaggcagaggacaaggag

SEQ ID NO: 456 - DNA, 52 bp, Homo sapiens
ggacgaggagcagaggcttaagaggaggcagtggacaaggaggatgatgagg

SEQ ID NO: 457 - DNA, 42 bp, Homo sapiens
ggacgaggagcagaggcttaagaggatgatgaggacaaagat

SEQ ID NO: 458 - DNA, 42 bp, Homo sapiens
ggagcagaggcttaaggaggagaggcagaggacaaggaggat

SEQ ID NO: 459 - DNA, 42 bp, Homo sapiens
ggcttaaggaggaggaagaagggaggaggcagaggacaagga

SEQ ID NO: 460 - DNA, 48 bp, Homo sapiens
ggcttaaggaggaggaagaagcgtttaagaggacaaggaggatgatga

SEQ ID NO: 461 - DNA, 42 bp, Homo sapiens
cttaaggaggaggaagaagacaacgcaaagaggaggaggagg

SEQ ID NO: 462 - DNA, 47 bp, Homo sapiens
cttaaggaggaggaagaagactgcgtgaggaggaggaggcagaggac

SEQ ID NO: 463 - DNA, 42 bp, Homo sapiens
cttaaggaggaggaagaagacaggaggcagaggacaaggagg

SEQ ID NO: 464 - DNA, 43 bp, Homo sapiens
taaggaggaggaagaagacaaaaggcagaggacaaggaggatg

SEQ ID NO: 465 - DNA, 42 bp, Homo sapiens
taaggaggaggaagaagacaaaaacgcaaagaggaggaggag

SEQ ID NO: 466 - DNA, 47 bp, Homo sapiens
aaggaggaggaagaagacaagtgtttcgcaaagaggaggaggaggca

SEQ ID NO: 467 - DNA, 42 bp, Homo sapiens
ggaagaagacaagaaacgcaaaaggaggatgatgaggacaaa

SEQ ID NO: 468 - DNA, 56 bp, Homo sapiens
gaagacaagaaacgcaaagagcctcctctttgtctaaggaggatgatgaggacaaa

SEQ ID NO: 469 - DNA, 53 bp, Homo sapiens
agacaagaaacgcaaagaggaccatccttgtcggaggatgatgaggacaaaga

SEQ ID NO: 470 - DNA, 49 bp, Homo sapiens
agaggaggaggaggcagagggcaattgtcggaggatgatgaggacaaag

SEQ ID NO: 471 - DNA, 46 bp, Homo sapiens
gaggaggaggaggcagaggactgtcggaggatgatgaggacaaaga

SEQ ID NO: 472 - DNA, 45 bp, Homo sapiens
gaggaggaggcagaggacaaatgtcggaggatgatgaggacaaag

SEQ ID NO: 473 - DNA, 48 bp, Homo sapiens
aggaggaggaggcagaggacacttgtcggaggatgatgaggacaaaga

SEQ ID NO: 474 - DNA, 48 bp, Homo sapiens
aggaggaggaggcagaggacatttgtcggaggatgatgaggacaaaga

SEQ ID NO: 475 - DNA, 45 bp, Homo sapiens
aggaggaggcagaggacaagtgtcggaggatgatgaggacaaaga

SEQ ID NO: 476 - DNA, 21 bp, Homo sapiens
aaggacaaacaggacgaggag

SEQ ID NO: 477 - DNA, 21 bp, Homo sapiens
aggacaaacaggacgaggagc

SEQ ID NO: 478 - DNA, 21 bp, Homo sapiens
ggacaaacaggacgaggagca

SEQ ID NO: 479 - DNA, 21 bp, Homo sapiens
gacaaacaggacgaggagcag

SEQ ID NO: 480 - DNA, 21 bp, Homo sapiens
acaaacaggacgaggagcagg

SEQ ID NO: 481 - DNA, 21 bp, Homo sapiens
caaacaggacgaggagcagag

SEQ ID NO: 482 - DNA, 21 bp, Homo sapiens
aaacaggacgaggagcagagg

SEQ ID NO: 483 - DNA, 21 bp, Homo sapiens
aacaggacgaggagcagagga

SEQ ID NO: 484 - DNA, 21 bp, Homo sapiens
acaggacgaggagcagaggac

SEQ ID NO: 485 - DNA, 21 bp, Homo sapiens
caggacgaggagcagaggaca

SEQ ID NO: 486 - DNA, 21 bp, Homo sapiens
aggacgaggagcagaggacaa

SEQ ID NO: 487 - DNA, 21 bp, Homo sapiens
ggacgaggagcagaggacaag

SEQ ID NO: 488 - DNA, 21 bp, Homo sapiens
gacgaggagcagaggacaagg

SEQ ID NO: 489 - DNA, 21 bp, Homo sapiens
acgaggagcagaggacaagga

SEQ ID NO: 490 - DNA, 21 bp, Homo sapiens
cgaggagcagaggacaaggag

SEQ ID NO: 491 - DNA, 21 bp, Homo sapiens
gaggagcagaggacaaggagg

SEQ ID NO: 492 - DNA, 21 bp, Homo sapiens
aggagcagaggacaaggagga

SEQ ID NO: 493 - DNA, 21 bp, Homo sapiens
ggagcagaggacaaggaggat

SEQ ID NO: 494 - DNA, 21 bp, Homo sapiens
gagcagaggacaaggaggatg

SEQ ID NO: 495 - DNA, 21 bp, Homo sapiens
agcagaggacaaggaggatga

SEQ ID NO: 496 - DNA, 21 bp, Homo sapiens
gaggaggaggcagaggacaat

SEQ ID NO: 497 - DNA, 21 bp, Homo sapiens
aggaggaggcagaggacaatt

SEQ ID NO: 498 - DNA, 21 bp, Homo sapiens
ggaggaggcagaggacaattg

SEQ ID NO: 499 - DNA, 21 bp, Homo sapiens
gaggaggcagaggacaattgt

SEQ ID NO: 500 - DNA, 21 bp, Homo sapiens
aggaggcagaggacaattgtc

SEQ ID NO: 501 - DNA, 21 bp, Homo sapiens
ggaggcagaggacaattgtcg

SEQ ID NO: 502 - DNA, 21 bp, Homo sapiens
gaggcagaggacaattgtcgg

SEQ ID NO: 503 - DNA, 21 bp, Homo sapiens
aggcagaggacaattgtcgga

SEQ ID NO: 504 - DNA, 21 bp, Homo sapiens
ggcagaggacaattgtcggag

SEQ ID NO: 505 - DNA, 21 bp, Homo sapiens
gcagaggacaattgtcggagg

SEQ ID NO: 506 - DNA, 21 bp, Homo sapiens
cagaggacaattgtcggagga

SEQ ID NO: 507 - DNA, 21 bp, Homo sapiens
agaggacaattgtcggaggat

SEQ ID NO: 508 - DNA, 21 bp, Homo sapiens
gaggacaattgtcggaggatg

SEQ ID NO: 509 - DNA, 21 bp, Homo sapiens
aggacaattgtcggaggatga

SEQ ID NO: 510 - DNA, 21 bp, Homo sapiens
ggacaattgtcggaggatgat

SEQ ID NO: 511 - DNA, 21 bp, Homo sapiens
gacaattgtcggaggatgatg

SEQ ID NO: 512 - DNA, 21 bp, Homo sapiens
acaattgtcggaggatgatga

SEQ ID NO: 513 - DNA, 21 bp, Homo sapiens
caattgtcggaggatgatgag

SEQ ID NO: 514 - DNA, 21 bp, Homo sapiens
aattgtcggaggatgatgagg

SEQ ID NO: 515 - DNA, 21 bp, Homo sapiens
attgtcggaggatgatgagga

SEQ ID NO: 516 - DNA, 21 bp, Homo sapiens
ttgtcggaggatgatgaggac

SEQ ID NO: 517 - DNA, 21 bp, Homo sapiens
tgtcggaggatgatgaggaca

SEQ ID NO: 518 - DNA, 21 bp, Homo sapiens
gtcggaggatgatgaggacaa

SEQ ID NO: 519 - DNA, 21 bp, Homo sapiens
tcggaggatgatgaggacaaa

SEQ ID NO: 520 - DNA, 21 bp, Homo sapiens
cggaggatgatgaggacaaag

SEQ ID NO: 521 - DNA, 21 bp, Homo sapiens
gacaaacaggacgaggagcag

SEQ ID NO: 522 - DNA, 21 bp, Homo sapiens
acaaacaggacgaggagcaga

SEQ ID NO: 523 - DNA, 21 bp, Homo sapiens
caaacaggacgaggagcagag

SEQ ID NO: 524 - DNA, 21 bp, Homo sapiens
aaacaggacgaggagcagagg

SEQ ID NO: 525 - DNA, 21 bp, Homo sapiens
aacaggacgaggagcagaggc

SEQ ID NO: 526 - DNA, 21 bp, Homo sapiens
acaggacgaggagcagaggca

SEQ ID NO: 527 - DNA, 21 bp, Homo sapiens
caggacgaggagcagaggcag

SEQ ID NO: 528 - DNA, 21 bp, Homo sapiens
aggacgaggagcagaggcaga

SEQ ID NO: 529 - DNA, 21 bp, Homo sapiens
ggacgaggagcagaggcagag

SEQ ID NO: 530 - DNA, 21 bp, Homo sapiens
gacgaggagcagaggcagagg

SEQ ID NO: 531 - DNA, 21 bp, Homo sapiens
acgaggagcagaggcagagga

SEQ ID NO: 532 - DNA, 21 bp, Homo sapiens
cgaggagcagaggcagaggac

SEQ ID NO: 533 - DNA, 21 bp, Homo sapiens
gaggagcagaggcagaggaca

SEQ ID NO: 534 - DNA, 21 bp, Homo sapiens
aggagcagaggcagaggacaa

SEQ ID NO: 535 - DNA, 21 bp, Homo sapiens
ggagcagaggcagaggacaag

SEQ ID NO: 536 - DNA, 21 bp, Homo sapiens
gagcagaggcagaggacaagg

SEQ ID NO: 537 - DNA, 21 bp, Homo sapiens
agcagaggcagaggacaagga

SEQ ID NO: 538 - DNA, 21 bp, Homo sapiens
gcagaggcagaggacaaggag

SEQ ID NO: 539 - DNA, 21 bp, Homo sapiens
cagaggcagaggacaaggagg

SEQ ID NO: 540 - DNA, 21 bp, Homo sapiens
agaggcagaggacaaggagga

SEQ ID NO: 541 - DNA, 21 bp, Homo sapiens
aggacgaggagcagaggctta

SEQ ID NO: 542 - DNA, 21 bp, Homo sapiens
ggacgaggagcagaggcttag

SEQ ID NO: 543 - DNA, 21 bp, Homo sapiens
gacgaggagcagaggcttagg

SEQ ID NO: 544 - DNA, 21 bp, Homo sapiens
acgaggagcagaggcttagga

SEQ ID NO: 545 - DNA, 21 bp, Homo sapiens
cgaggagcagaggcttaggag

SEQ ID NO: 546 - DNA, 21 bp, Homo sapiens
gaggagcagaggcttaggagg

SEQ ID NO: 547 - DNA, 21 bp, Homo sapiens
aggagcagaggcttaggagga

SEQ ID NO: 548 - DNA, 21 bp, Homo sapiens
ggagcagaggcttaggaggag

SEQ ID NO: 549 - DNA, 21 bp, Homo sapiens
gagcagaggcttaggaggagg

SEQ ID NO: 550 - DNA, 21 bp, Homo sapiens
agcagaggcttaggaggaggc

SEQ ID NO: 551 - DNA, 21 bp, Homo sapiens
gcagaggcttaggaggaggca

SEQ ID NO: 552 - DNA, 21 bp, Homo sapiens
cagaggcttaggaggaggcag

SEQ ID NO: 553 - DNA, 21 bp, Homo sapiens
agaggcttaggaggaggcaga

SEQ ID NO: 554 - DNA, 21 bp, Homo sapiens
gaggcttaggaggaggcagag

SEQ ID NO: 555 - DNA, 21 bp, Homo sapiens
aggcttaggaggaggcagagg

SEQ ID NO: 556 - DNA, 21 bp, Homo sapiens
ggcttaggaggaggcagagga

SEQ ID NO: 557 - DNA, 21 bp, Homo sapiens
gcttaggaggaggcagaggac

SEQ ID NO: 558 - DNA, 21 bp, Homo sapiens
cttaggaggaggcagaggaca

SEQ ID NO: 559 - DNA, 21 bp, Homo sapiens
ttaggaggaggcagaggacaa

SEQ ID NO: 560 - DNA, 21 bp, Homo sapiens
taggaggaggcagaggacaag

SEQ ID NO: 561 - DNA, 21 bp, Homo sapiens
gaaggacaaacaggacgaggg

SEQ ID NO: 562 - DNA, 21 bp, Homo sapiens
aaggacaaacaggacgagggg

SEQ ID NO: 563 - DNA, 21 bp, Homo sapiens
aggacaaacaggacgaggggc

SEQ ID NO: 564 - DNA, 21 bp, Homo sapiens
ggacaaacaggacgaggggca

SEQ ID NO: 565 - DNA, 21 bp, Homo sapiens
gacaaacaggacgaggggcag

SEQ ID NO: 566 - DNA, 21 bp, Homo sapiens
acaaacaggacgaggggcaga

SEQ ID NO: 567 - DNA, 21 bp, Homo sapiens
caaacaggacgaggggcagag

SEQ ID NO: 568 - DNA, 21 bp, Homo sapiens
aaacaggacgaggggcagagg

SEQ ID NO: 569 - DNA, 21 bp, Homo sapiens
aacaggacgaggggcagagga

SEQ ID NO: 570 - DNA, 21 bp, Homo sapiens
acaggacgaggggcagaggac

SEQ ID NO: 571 - DNA, 21 bp, Homo sapiens
caggacgaggggcagaggaca

SEQ ID NO: 572 - DNA, 21 bp, Homo sapiens
aggacgaggggcagaggacaa

SEQ ID NO: 573 - DNA, 21 bp, Homo sapiens
ggacgaggggcagaggacaag

SEQ ID NO: 574 - DNA, 21 bp, Homo sapiens
gacgaggggcagaggacaagg

SEQ ID NO: 575 - DNA, 21 bp, Homo sapiens
acgaggggcagaggacaagga

SEQ ID NO: 576 - DNA, 21 bp, Homo sapiens
cgaggggcagaggacaaggag

SEQ ID NO: 577 - DNA, 21 bp, Homo sapiens
gaggggcagaggacaaggagg

SEQ ID NO: 578 - DNA, 21 bp, Homo sapiens
aggggcagaggacaaggagga

SEQ ID NO: 579 - DNA, 21 bp, Homo sapiens
ggggcagaggacaaggaggat

SEQ ID NO: 580 - DNA, 21 bp, Homo sapiens
gggcagaggacaaggaggatg

SEQ ID NO: 581 - DNA, 21 bp, Homo sapiens
ggacaaacaggacgaggagcg

SEQ ID NO: 582 - DNA, 21 bp, Homo sapiens
gacaaacaggacgaggagcgg

SEQ ID NO: 583 - DNA, 21 bp, Homo sapiens
acaaacaggacgaggagcgga

SEQ ID NO: 584 - DNA, 21 bp, Homo sapiens
caaacaggacgaggagcggag

SEQ ID NO: 585 - DNA, 21 bp, Homo sapiens
aaacaggacgaggagcggagg

SEQ ID NO: 586 - DNA, 21 bp, Homo sapiens
aacaggacgaggagcggaggc

SEQ ID NO: 587 - DNA, 21 bp, Homo sapiens
acaggacgaggagcggaggca

SEQ ID NO: 588 - DNA, 21 bp, Homo sapiens
caggacgaggagcggaggcag

SEQ ID NO: 589 - DNA, 21 bp, Homo sapiens
aggacgaggagcggaggcaga

SEQ ID NO: 590 - DNA, 21 bp, Homo sapiens
ggacgaggagcggaggcagag

SEQ ID NO: 591 - DNA, 21 bp, Homo sapiens
gacgaggagcggaggcagagg

SEQ ID NO: 592 - DNA, 21 bp, Homo sapiens
acgaggagcggaggcagagga

SEQ ID NO: 593 - DNA, 21 bp, Homo sapiens
cgaggagcggaggcagaggac

SEQ ID NO: 594 - DNA, 21 bp, Homo sapiens
gaggagcggaggcagaggaca

SEQ ID NO: 595 - DNA, 21 bp, Homo sapiens
aggagcggaggcagaggacaa

SEQ ID NO: 596 - DNA, 21 bp, Homo sapiens
ggagcggaggcagaggacaag

SEQ ID NO: 597 - DNA, 21 bp, Homo sapiens
gagcggaggcagaggacaagg

SEQ ID NO: 598 - DNA, 21 bp, Homo sapiens
agcggaggcagaggacaagga

SEQ ID NO: 599 - DNA, 21 bp, Homo sapiens
gcggaggcagaggacaaggag

SEQ ID NO: 600 - DNA, 21 bp, Homo sapiens
cggaggcagaggacaaggagg

SEQ ID NO: 601 - DNA, 21 bp, Homo sapiens
aggacgaggagcagaggctta

SEQ ID NO: 602 - DNA, 21 bp, Homo sapiens
ggacgaggagcagaggcttag

SEQ ID NO: 603 - DNA, 21 bp, Homo sapiens
gacgaggagcagaggcttagg

SEQ ID NO: 604 - DNA, 21 bp, Homo sapiens
acgaggagcagaggcttagga

SEQ ID NO: 605 - DNA, 21 bp, Homo sapiens
cgaggagcagaggcttaggag

SEQ ID NO: 606 - DNA, 21 bp, Homo sapiens
gaggagcagaggcttaggagg

SEQ ID NO: 607 - DNA, 21 bp, Homo sapiens
aggagcagaggcttaggagga

SEQ ID NO: 608 - DNA, 21 bp, Homo sapiens
ggagcagaggcttaggaggat

SEQ ID NO: 609 - DNA, 21 bp, Homo sapiens
gagcagaggcttaggaggatg

SEQ ID NO: 610 - DNA, 21 bp, Homo sapiens
agcagaggcttaggaggatga

SEQ ID NO: 611 - DNA, 21 bp, Homo sapiens
gcagaggcttaggaggatgat

SEQ ID NO: 612 - DNA, 21 bp, Homo sapiens
cagaggcttaggaggatgatg

SEQ ID NO: 613 - DNA, 21 bp, Homo sapiens
agaggcttaggaggatgatga

SEQ ID NO: 614 - DNA, 21 bp, Homo sapiens
gaggcttaggaggatgatgag

SEQ ID NO: 615 - DNA, 21 bp, Homo sapiens
aggcttaggaggatgatgagg

SEQ ID NO: 616 - DNA, 21 bp, Homo sapiens
ggcttaggaggatgatgagga

SEQ ID NO: 617 - DNA, 21 bp, Homo sapiens
gcttaggaggatgatgaggac

SEQ ID NO: 618 - DNA, 21 bp, Homo sapiens
cttaggaggatgatgaggaca

SEQ ID NO: 619 - DNA, 21 bp, Homo sapiens
ttaggaggatgatgaggacaa

SEQ ID NO: 620 - DNA, 21 bp, Homo sapiens
taggaggatgatgaggacaaa

SEQ ID NO: 621 - DNA, 21 bp, Homo sapiens
gacgaggagcagaggcttaag

SEQ ID NO: 622 - DNA, 21 bp, Homo sapiens
acgaggagcagaggcttaaga

SEQ ID NO: 623 - DNA, 21 bp, Homo sapiens
cgaggagcagaggcttaagag

SEQ ID NO: 624 - DNA, 21 bp, Homo sapiens
gaggagcagaggcttaagagg

SEQ ID NO: 625 - DNA, 21 bp, Homo sapiens
aggagcagaggcttaagagga

SEQ ID NO: 626 - DNA, 21 bp, Homo sapiens
ggagcagaggcttaagaggag

SEQ ID NO: 627 - DNA, 21 bp, Homo sapiens
gagcagaggcttaagaggagg

SEQ ID NO: 628 - DNA, 21 bp, Homo sapiens
agcagaggcttaagaggaggc

SEQ ID NO: 629 - DNA, 21 bp, Homo sapiens
gcagaggcttaagaggaggca

SEQ ID NO: 630 - DNA, 21 bp, Homo sapiens
cagaggcttaagaggaggcag

SEQ ID NO: 631 - DNA, 21 bp, Homo sapiens
agaggcttaagaggaggcaga

SEQ ID NO: 632 - DNA, 21 bp, Homo sapiens
gaggcttaagaggaggcagag

SEQ ID NO: 633 - DNA, 21 bp, Homo sapiens
aggcttaagaggaggcagagg

SEQ ID NO: 634 - DNA, 21 bp, Homo sapiens
ggcttaagaggaggcagagga

SEQ ID NO: 635 - DNA, 21 bp, Homo sapiens
gcttaagaggaggcagaggac

SEQ ID NO: 636 - DNA, 21 bp, Homo sapiens
cttaagaggaggcagaggaca

SEQ ID NO: 637 - DNA, 21 bp, Homo sapiens
ttaagaggaggcagaggacaa

SEQ ID NO: 638 - DNA, 21 bp, Homo sapiens
taagaggaggcagaggacaag

SEQ ID NO: 639 - DNA, 21 bp, Homo sapiens
aagaggaggcagaggacaagg

SEQ ID NO: 640 - DNA, 21 bp, Homo sapiens
agaggaggcagaggacaagga

SEQ ID NO: 641 - DNA, 21 bp, Homo sapiens
aagaaacgcaaagaggaggag

SEQ ID NO: 642 - DNA, 21 bp, Homo sapiens
agaaacgcaaagaggaggaga

SEQ ID NO: 643 - DNA, 21 bp, Homo sapiens
gaaacgcaaagaggaggagag

SEQ ID NO: 644 - DNA, 21 bp, Homo sapiens
aaacgcaaagaggaggagagg

SEQ ID NO: 645 - DNA, 21 bp, Homo sapiens
aacgcaaagaggaggagaggc

SEQ ID NO: 646 - DNA, 21 bp, Homo sapiens
acgcaaagaggaggagaggca

SEQ ID NO: 647 - DNA, 21 bp, Homo sapiens
cgcaaagaggaggagaggcag

SEQ ID NO: 648 - DNA, 21 bp, Homo sapiens
gcaaagaggaggagaggcaga

SEQ ID NO: 649 - DNA, 21 bp, Homo sapiens
caaagaggaggagaggcagag

SEQ ID NO: 650 - DNA, 21 bp, Homo sapiens
aaagaggaggagaggcagagg

SEQ ID NO: 651 - DNA, 21 bp, Homo sapiens
aagaggaggagaggcagagga

SEQ ID NO: 652 - DNA, 21 bp, Homo sapiens
agaggaggagaggcagaggac

SEQ ID NO: 653 - DNA, 21 bp, Homo sapiens
gaggaggagaggcagaggaca

SEQ ID NO: 654 - DNA, 21 bp, Homo sapiens
aggaggagaggcagaggacaa

SEQ ID NO: 655 - DNA, 21 bp, Homo sapiens
ggaggagaggcagaggacaag

SEQ ID NO: 656 - DNA, 21 bp, Homo sapiens
gaggagaggcagaggacaagg

SEQ ID NO: 657 - DNA, 21 bp, Homo sapiens
aggagaggcagaggacaagga

SEQ ID NO: 658 - DNA, 21 bp, Homo sapiens
ggagaggcagaggacaaggag

SEQ ID NO: 659 - DNA, 21 bp, Homo sapiens
gagaggcagaggacaaggagg

SEQ ID NO: 660 - DNA, 21 bp, Homo sapiens
agaggcagaggacaaggagga

SEQ ID NO: 661 - DNA, 21 bp, Homo sapiens
ggaggaggaggcagaggacat

SEQ ID NO: 662 - DNA, 21 bp, Homo sapiens
gaggaggaggcagaggacatg

SEQ ID NO: 663 - DNA, 21 bp, Homo sapiens
aggaggaggcagaggacatgt

SEQ ID NO: 664 - DNA, 21 bp, Homo sapiens
ggaggaggcagaggacatgtg

SEQ ID NO: 665 - DNA, 21 bp, Homo sapiens
gaggaggcagaggacatgtgt

SEQ ID NO: 666 - DNA, 21 bp, Homo sapiens
aggaggcagaggacatgtgtc

SEQ ID NO: 667 - DNA, 21 bp, Homo sapiens
ggaggcagaggacatgtgtcg

SEQ ID NO: 668 - DNA, 21 bp, Homo sapiens
gaggcagaggacatgtgtcgg

SEQ ID NO: 669 - DNA, 21 bp, Homo sapiens
aggcagaggacatgtgtcgga

SEQ ID NO: 670 - DNA, 21 bp, Homo sapiens
ggcagaggacatgtgtcggag

SEQ ID NO: 671 - DNA, 21 bp, Homo sapiens
gcagaggacatgtgtcggagg

SEQ ID NO: 672 - DNA, 21 bp, Homo sapiens
cagaggacatgtgtcggagga

SEQ ID NO: 673 - DNA, 21 bp, Homo sapiens
agaggacatgtgtcggaggat

SEQ ID NO: 674 - DNA, 21 bp, Homo sapiens
gaggacatgtgtcggaggatg

SEQ ID NO: 675 - DNA, 21 bp, Homo sapiens
aggacatgtgtcggaggatga

SEQ ID NO: 676 - DNA, 21 bp, Homo sapiens
ggacatgtgtcggaggatgat

SEQ ID NO: 677 - DNA, 21 bp, Homo sapiens
gacatgtgtcggaggatgatg

SEQ ID NO: 678 - DNA, 21 bp, Homo sapiens
acatgtgtcggaggatgatga

SEQ ID NO: 679 - DNA, 21 bp, Homo sapiens
catgtgtcggaggatgatgag

SEQ ID NO: 680 - DNA, 21 bp, Homo sapiens
atgtgtcggaggatgatgagg

SEQ ID NO: 681 - DNA, 21 bp, Homo sapiens
tgtgtcggaggatgatgagga

SEQ ID NO: 682 - DNA, 21 bp, Homo sapiens
gtgtcggaggatgatgaggac

SEQ ID NO: 683 - DNA, 21 bp, Homo sapiens
tgtcggaggatgatgaggaca

SEQ ID NO: 684 - DNA, 21 bp, Homo sapiens
gtcggaggatgatgaggacaa

SEQ ID NO: 685 - DNA, 21 bp, Homo sapiens
tcggaggatgatgaggacaaa

SEQ ID NO: 686 - DNA, 21 bp, Homo sapiens
cggaggatgatgaggacaaag

SEQ ID NO: 687 - DNA, 21 bp, Homo sapiens
aaggacaaacaggacgaggac

SEQ ID NO: 688 - DNA, 21 bp, Homo sapiens
aggacaaacaggacgaggacc

SEQ ID NO: 689 - DNA, 21 bp, Homo sapiens
ggacaaacaggacgaggacca

SEQ ID NO: 690 - DNA, 21 bp, Homo sapiens
gacaaacaggacgaggaccag

SEQ ID NO: 691 - DNA, 21 bp, Homo sapiens
acaaacaggacgaggaccaga

SEQ ID NO: 692 - DNA, 21 bp, Homo sapiens
caaacaggacgaggaccagag

SEQ ID NO: 693 - DNA, 21 bp, Homo sapiens
aaacaggacgaggaccagagg

SEQ ID NO: 694 - DNA, 21 bp, Homo sapiens
aacaggacgaggaccagaggc

SEQ ID NO: 695 - DNA, 21 bp, Homo sapiens
acaggacgaggaccagaggca

SEQ ID NO: 696 - DNA, 21 bp, Homo sapiens
caggacgaggaccagaggcag

SEQ ID NO: 697 - DNA, 21 bp, Homo sapiens
aggacgaggaccagaggcaga

SEQ ID NO: 698 - DNA, 21 bp, Homo sapiens
ggacgaggaccagaggcagag

SEQ ID NO: 699 - DNA, 21 bp, Homo sapiens
gacgaggaccagaggcagagg

SEQ ID NO: 700 - DNA, 21 bp, Homo sapiens
acgaggaccagaggcagagga

SEQ ID NO: 701 - DNA, 21 bp, Homo sapiens
cgaggaccagaggcagaggac

SEQ ID NO: 702 - DNA, 21 bp, Homo sapiens
gaggaccagaggcagaggaca

SEQ ID NO: 703 - DNA, 21 bp, Homo sapiens
aggaccagaggcagaggacaa

SEQ ID NO: 704 - DNA, 21 bp, Homo sapiens
ggaccagaggcagaggacaag

SEQ ID NO: 705 - DNA, 21 bp, Homo sapiens
gaccagaggcagaggacaagg

SEQ ID NO: 706 - DNA, 21 bp, Homo sapiens
accagaggcagaggacaagga

SEQ ID NO: 707 - DNA, 21 bp, Homo sapiens
ccagaggcagaggacaaggag

SEQ ID NO: 708 - DNA, 21 bp, Homo sapiens
cagaggcagaggacaaggagg

SEQ ID NO: 709 - DNA, 21 bp, Homo sapiens
agaggcagaggacaaggagga

SEQ ID NO: 710 - DNA, 21 bp, Homo sapiens
aaacaggacgaggagcagagg

SEQ ID NO: 711 - DNA, 21 bp, Homo sapiens
aacaggacgaggagcagagga

SEQ ID NO: 712 - DNA, 21 bp, Homo sapiens
acaggacgaggagcagaggag

SEQ ID NO: 713 - DNA, 21 bp, Homo sapiens
caggacgaggagcagaggagg

SEQ ID NO: 714 - DNA, 21 bp, Homo sapiens
aggacgaggagcagaggagga

SEQ ID NO: 715 - DNA, 21 bp, Homo sapiens
ggacgaggagcagaggaggag

SEQ ID NO: 716 - DNA, 21 bp, Homo sapiens
gacgaggagcagaggaggagg

SEQ ID NO: 717 - DNA, 21 bp, Homo sapiens
acgaggagcagaggaggagga

SEQ ID NO: 718 - DNA, 21 bp, Homo sapiens
cgaggagcagaggaggaggag

SEQ ID NO: 719 - DNA, 21 bp, Homo sapiens
gaggagcagaggaggaggagg

SEQ ID NO: 720 - DNA, 21 bp, Homo sapiens
aggagcagaggaggaggagga

SEQ ID NO: 721 - DNA, 21 bp, Homo sapiens
ggagcagaggaggaggaggag

SEQ ID NO: 722 - DNA, 21 bp, Homo sapiens
gagcagaggaggaggaggagg

SEQ ID NO: 723 - DNA, 21 bp, Homo sapiens
agcagaggaggaggaggaggc

SEQ ID NO: 724 - DNA, 21 bp, Homo sapiens
gcagaggaggaggaggaggca

SEQ ID NO: 725 - DNA, 21 bp, Homo sapiens
cagaggaggaggaggaggcag

SEQ ID NO: 726 - DNA, 21 bp, Homo sapiens
agaggaggaggaggaggcaga

SEQ ID NO: 727 - DNA, 21 bp, Homo sapiens
gaggaggaggaggaggcagag

SEQ ID NO: 728 - DNA, 21 bp, Homo sapiens
aggaggaggaggaggcagagg

SEQ ID NO: 729 - DNA, 21 bp, Homo sapiens
ggaggaggaggaggcagagga

SEQ ID NO: 730 - DNA, 21 bp, Homo sapiens
acaggacgaggagcagaggca

SEQ ID NO: 731 - DNA, 21 bp, Homo sapiens
caggacgaggagcagaggcag

SEQ ID NO: 732 - DNA, 21 bp, Homo sapiens
aggacgaggagcagaggcaga

SEQ ID NO: 733 - DNA, 21 bp, Homo sapiens
ggacgaggagcagaggcagag

SEQ ID NO: 734 - DNA, 21 bp, Homo sapiens
gacgaggagcagaggcagagg

SEQ ID NO: 735 - DNA, 21 bp, Homo sapiens
acgaggagcagaggcagagga

SEQ ID NO: 736 - DNA, 21 bp, Homo sapiens
cgaggagcagaggcagaggag

SEQ ID NO: 737 - DNA, 21 bp, Homo sapiens
gaggagcagaggcagaggagg

SEQ ID NO: 738 - DNA, 21 bp, Homo sapiens
aggagcagaggcagaggagga

SEQ ID NO: 739 - DNA, 21 bp, Homo sapiens
ggagcagaggcagaggaggag

SEQ ID NO: 740 - DNA, 21 bp, Homo sapiens
gagcagaggcagaggaggagg

SEQ ID NO: 741 - DNA, 21 bp, Homo sapiens
agcagaggcagaggaggaggc

SEQ ID NO: 742 - DNA, 21 bp, Homo sapiens
gcagaggcagaggaggaggca

SEQ ID NO: 743 - DNA, 21 bp, Homo sapiens
cagaggcagaggaggaggcag

SEQ ID NO: 744 - DNA, 21 bp, Homo sapiens
agaggcagaggaggaggcaga

SEQ ID NO: 745 - DNA, 21 bp, Homo sapiens
gaggcagaggaggaggcagag

SEQ ID NO: 746 - DNA, 21 bp, Homo sapiens
aggcagaggaggaggcagagg

SEQ ID NO: 747 - DNA, 21 bp, Homo sapiens
ggcagaggaggaggcagagga

SEQ ID NO: 748 - DNA, 21 bp, Homo sapiens
gcagaggaggaggcagaggac

SEQ ID NO: 749 - DNA, 21 bp, Homo sapiens
cagaggaggaggcagaggaca

SEQ ID NO: 750 - DNA, 21 bp, Homo sapiens
agaggaggaggcagaggacaa

SEQ ID NO: 751 - DNA, 21 bp, Homo sapiens
caggacgaggagcagaggctg

SEQ ID NO: 752 - DNA, 21 bp, Homo sapiens
aggacgaggagcagaggctga

SEQ ID NO: 753 - DNA, 21 bp, Homo sapiens
ggacgaggagcagaggctgag

SEQ ID NO: 754 - DNA, 21 bp, Homo sapiens
gacgaggagcagaggctgagg

SEQ ID NO: 755 - DNA, 21 bp, Homo sapiens
acgaggagcagaggctgagga

SEQ ID NO: 756 - DNA, 21 bp, Homo sapiens
cgaggagcagaggctgaggag

SEQ ID NO: 757 - DNA, 21 bp, Homo sapiens
gaggagcagaggctgaggagg

SEQ ID NO: 758 - DNA, 21 bp, Homo sapiens
aggagcagaggctgaggagga

SEQ ID NO: 759 - DNA, 21 bp, Homo sapiens
ggagcagaggctgaggaggag

SEQ ID NO: 760 - DNA, 21 bp, Homo sapiens
gagcagaggctgaggaggagg

SEQ ID NO: 761 - DNA, 21 bp, Homo sapiens
agcagaggctgaggaggaggc

SEQ ID NO: 762 - DNA, 21 bp, Homo sapiens
gcagaggctgaggaggaggca

SEQ ID NO: 763 - DNA, 21 bp, Homo sapiens
cagaggctgaggaggaggcag

SEQ ID NO: 764 - DNA, 21 bp, Homo sapiens
agaggctgaggaggaggcaga

SEQ ID NO: 765 - DNA, 21 bp, Homo sapiens
gaggctgaggaggaggcagag

SEQ ID NO: 766 - DNA, 21 bp, Homo sapiens
aggctgaggaggaggcagagg

SEQ ID NO: 767 - DNA, 21 bp, Homo sapiens
ggctgaggaggaggcagagga

SEQ ID NO: 768 - DNA, 21 bp, Homo sapiens
gctgaggaggaggcagaggac

SEQ ID NO: 769 - DNA, 21 bp, Homo sapiens
ctgaggaggaggcagaggaca

SEQ ID NO: 770 - DNA, 21 bp, Homo sapiens
tgaggaggaggcagaggacaa

SEQ ID NO: 771 - DNA, 21 bp, Homo sapiens
aggacgaggagcagaggctta

SEQ ID NO: 772 - DNA, 21 bp, Homo sapiens
ggacgaggagcagaggcttag

SEQ ID NO: 773 - DNA, 21 bp, Homo sapiens
gacgaggagcagaggcttagg

SEQ ID NO: 774 - DNA, 21 bp, Homo sapiens
acgaggagcagaggcttagga

SEQ ID NO: 775 - DNA, 21 bp, Homo sapiens
cgaggagcagaggcttaggag

SEQ ID NO: 776 - DNA, 21 bp, Homo sapiens
gaggagcagaggcttaggagg

SEQ ID NO: 777 - DNA, 21 bp, Homo sapiens
aggagcagaggcttaggagga

SEQ ID NO: 778 - DNA, 21 bp, Homo sapiens
ggagcagaggcttaggaggag

SEQ ID NO: 779 - DNA, 21 bp, Homo sapiens
gagcagaggcttaggaggagg

SEQ ID NO: 780 - DNA, 21 bp, Homo sapiens
agcagaggcttaggaggaggg

SEQ ID NO: 781 - DNA, 21 bp, Homo sapiens
gcagaggcttaggaggaggga

SEQ ID NO: 782 - DNA, 21 bp, Homo sapiens
cagaggcttaggaggagggag

SEQ ID NO: 783 - DNA, 21 bp, Homo sapiens
agaggcttaggaggagggaga

SEQ ID NO: 784 - DNA, 21 bp, Homo sapiens
gaggcttaggaggagggagag

SEQ ID NO: 785 - DNA, 21 bp, Homo sapiens
aggcttaggaggagggagagg

SEQ ID NO: 786 - DNA, 21 bp, Homo sapiens
ggcttaggaggagggagagga

SEQ ID NO: 787 - DNA, 21 bp, Homo sapiens
gcttaggaggagggagaggac

SEQ ID NO: 788 - DNA, 21 bp, Homo sapiens
cttaggaggagggagaggaca

SEQ ID NO: 789 - DNA, 21 bp, Homo sapiens
ttaggaggagggagaggacaa

SEQ ID NO: 790 - DNA, 21 bp, Homo sapiens
taggaggagggagaggacaag

SEQ ID NO: 791 - DNA, 21 bp, Homo sapiens
aggaggagggagaggacaagg

SEQ ID NO: 792 - DNA, 21 bp, Homo sapiens
ggaggagggagaggacaagga

SEQ ID NO: 793 - DNA, 21 bp, Homo sapiens
gaggagggagaggacaaggag

SEQ ID NO: 794 - DNA, 21 bp, Homo sapiens
aggagggagaggacaaggagg

SEQ ID NO: 795 - DNA, 21 bp, Homo sapiens
ggagggagaggacaaggagga

SEQ ID NO: 796 - DNA, 21 bp, Homo sapiens
gagggagaggacaaggaggat

SEQ ID NO: 797 - DNA, 21 bp, Homo sapiens
agggagaggacaaggaggatg

SEQ ID NO: 798 - DNA, 21 bp, Homo sapiens
gggagaggacaaggaggatga

SEQ ID NO: 799 - DNA, 21 bp, Homo sapiens
ggagaggacaaggaggatgat

SEQ ID NO: 800 - DNA, 21 bp, Homo sapiens
gagaggacaaggaggatgatg

SEQ ID NO: 801 - DNA, 21 bp, Homo sapiens
aggacgaggagcagaggcttc

SEQ ID NO: 802 - DNA, 21 bp, Homo sapiens
ggacgaggagcagaggcttca

SEQ ID NO: 803 - DNA, 21 bp, Homo sapiens
gacgaggagcagaggcttcag

SEQ ID NO: 804 - DNA, 21 bp, Homo sapiens
acgaggagcagaggcttcaga

SEQ ID NO: 805 - DNA, 21 bp, Homo sapiens
cgaggagcagaggcttcagag

SEQ ID NO: 806 - DNA, 21 bp, Homo sapiens
gaggagcagaggcttcagagg

SEQ ID NO: 807 - DNA, 21 bp, Homo sapiens
aggagcagaggcttcagagga

SEQ ID NO: 808 - DNA, 21 bp, Homo sapiens
ggagcagaggcttcagaggag

SEQ ID NO: 809 - DNA, 21 bp, Homo sapiens
gagcagaggcttcagaggagg

SEQ ID NO: 810 - DNA, 21 bp, Homo sapiens
agcagaggcttcagaggaggc

SEQ ID NO: 811 - DNA, 21 bp, Homo sapiens
gcagaggcttcagaggaggca

SEQ ID NO: 812 - DNA, 21 bp, Homo sapiens
cagaggcttcagaggaggcag

SEQ ID NO: 813 - DNA, 21 bp, Homo sapiens
agaggcttcagaggaggcaga

SEQ ID NO: 814 - DNA, 21 bp, Homo sapiens
gaggcttcagaggaggcagag

SEQ ID NO: 815 - DNA, 21 bp, Homo sapiens
aggcttcagaggaggcagagg

SEQ ID NO: 816 - DNA, 21 bp, Homo sapiens
ggcttcagaggaggcagagga

SEQ ID NO: 817 - DNA, 21 bp, Homo sapiens
gcttcagaggaggcagaggac

SEQ ID NO: 818 - DNA, 21 bp, Homo sapiens
cttcagaggaggcagaggaca

SEQ ID NO: 819 - DNA, 21 bp, Homo sapiens
ttcagaggaggcagaggacaa

SEQ ID NO: 820 - DNA, 21 bp, Homo sapiens
tcagaggaggcagaggacaag

SEQ ID NO: 821 - DNA, 21 bp, Homo sapiens
cagaggaggcagaggacaagg

SEQ ID NO: 822 - DNA, 21 bp, Homo sapiens
agaggaggcagaggacaagga

SEQ ID NO: 823 - DNA, 21 bp, Homo sapiens
gacgaggagcagaggcttaag

SEQ ID NO: 824 - DNA, 21 bp, Homo sapiens
acgaggagcagaggcttaaga

SEQ ID NO: 825 - DNA, 21 bp, Homo sapiens
cgaggagcagaggcttaagag

SEQ ID NO: 826 - DNA, 21 bp, Homo sapiens
gaggagcagaggcttaagagg

SEQ ID NO: 827 - DNA, 21 bp, Homo sapiens
aggagcagaggcttaagagga

SEQ ID NO: 828 - DNA, 21 bp, Homo sapiens
ggagcagaggcttaagaggag

SEQ ID NO: 829 - DNA, 21 bp, Homo sapiens
gagcagaggcttaagaggagg

SEQ ID NO: 830 - DNA, 21 bp, Homo sapiens
agcagaggcttaagaggaggc

SEQ ID NO: 831 - DNA, 21 bp, Homo sapiens
gcagaggcttaagaggaggca

SEQ ID NO: 832 - DNA, 21 bp, Homo sapiens
cagaggcttaagaggaggcag

SEQ ID NO: 833 - DNA, 21 bp, Homo sapiens
agaggcttaagaggaggcagt

SEQ ID NO: 834 - DNA, 21 bp, Homo sapiens
gaggcttaagaggaggcagtg

SEQ ID NO: 835 - DNA, 21 bp, Homo sapiens
aggcttaagaggaggcagtgg

SEQ ID NO: 836 - DNA, 21 bp, Homo sapiens
ggcttaagaggaggcagtgga

SEQ ID NO: 837 - DNA, 21 bp, Homo sapiens
gcttaagaggaggcagtggac

SEQ ID NO: 838 - DNA, 21 bp, Homo sapiens
cttaagaggaggcagtggaca

SEQ ID NO: 839 - DNA, 21 bp, Homo sapiens
ttaagaggaggcagtggacaa

SEQ ID NO: 840 - DNA, 21 bp, Homo sapiens
taagaggaggcagtggacaag

SEQ ID NO: 841 - DNA, 21 bp, Homo sapiens
aagaggaggcagtggacaagg

SEQ ID NO: 842 - DNA, 21 bp, Homo sapiens
agaggaggcagtggacaagga

SEQ ID NO: 843 - DNA, 21 bp, Homo sapiens
gaggaggcagtggacaaggag

SEQ ID NO: 844 - DNA, 21 bp, Homo sapiens
aggaggcagtggacaaggagg

SEQ ID NO: 845 - DNA, 21 bp, Homo sapiens
ggaggcagtggacaaggagga

SEQ ID NO: 846 - DNA, 21 bp, Homo sapiens
gaggcagtggacaaggaggat

SEQ ID NO: 847 - DNA, 21 bp, Homo sapiens
aggcagtggacaaggaggatg

SEQ ID NO: 848 - DNA, 21 bp, Homo sapiens
ggcagtggacaaggaggatga

SEQ ID NO: 849 - DNA, 21 bp, Homo sapiens
gcagtggacaaggaggatgat

SEQ ID NO: 850 - DNA, 21 bp, Homo sapiens
cagtggacaaggaggatgatg

SEQ ID NO: 851 - DNA, 21 bp, Homo sapiens
agtggacaaggaggatgatga

SEQ ID NO: 852 - DNA, 21 bp, Homo sapiens
gtggacaaggaggatgatgag

SEQ ID NO: 853 - DNA, 21 bp, Homo sapiens
tggacaaggaggatgatgagg

SEQ ID NO: 854 - DNA, 21 bp, Homo sapiens
gacgaggagcagaggcttaag

SEQ ID NO: 855 - DNA, 21 bp, Homo sapiens
acgaggagcagaggcttaaga

SEQ ID NO: 856 - DNA, 21 bp, Homo sapiens
cgaggagcagaggcttaagag

SEQ ID NO: 857 - DNA, 21 bp, Homo sapiens
gaggagcagaggcttaagagg

SEQ ID NO: 858 - DNA, 21 bp, Homo sapiens
aggagcagaggcttaagagga

SEQ ID NO: 859 - DNA, 21 bp, Homo sapiens
ggagcagaggcttaagaggat

SEQ ID NO: 860 - DNA, 21 bp, Homo sapiens
gagcagaggcttaagaggatg

SEQ ID NO: 861 - DNA, 21 bp, Homo sapiens
agcagaggcttaagaggatga

SEQ ID NO: 862 - DNA, 21 bp, Homo sapiens
gcagaggcttaagaggatgat

SEQ ID NO: 863 - DNA, 21 bp, Homo sapiens
cagaggcttaagaggatgatg

SEQ ID NO: 864 - DNA, 21 bp, Homo sapiens
agaggcttaagaggatgatga

SEQ ID NO: 865 - DNA, 21 bp, Homo sapiens
gaggcttaagaggatgatgag

SEQ ID NO: 866 - DNA, 21 bp, Homo sapiens
aggcttaagaggatgatgagg

SEQ ID NO: 867 - DNA, 21 bp, Homo sapiens
ggcttaagaggatgatgagga

SEQ ID NO: 868 - DNA, 21 bp, Homo sapiens
gcttaagaggatgatgaggac

SEQ ID NO: 869 - DNA, 21 bp, Homo sapiens
cttaagaggatgatgaggaca

SEQ ID NO: 870 - DNA, 21 bp, Homo sapiens
ttaagaggatgatgaggacaa

SEQ ID NO: 871 - DNA, 21 bp, Homo sapiens
taagaggatgatgaggacaaa

SEQ ID NO: 872 - DNA, 21 bp, Homo sapiens
aagaggatgatgaggacaaag

SEQ ID NO: 873 - DNA, 21 bp, Homo sapiens
agaggatgatgaggacaaaga

SEQ ID NO: 874 - DNA, 21 bp, Homo sapiens
gagcagaggcttaaggaggag

SEQ ID NO: 875 - DNA, 21 bp, Homo sapiens
agcagaggcttaaggaggaga

SEQ ID NO: 876 - DNA, 21 bp, Homo sapiens
gcagaggcttaaggaggagag

SEQ ID NO: 877 - DNA, 21 bp, Homo sapiens
cagaggcttaaggaggagagg

SEQ ID NO: 878 - DNA, 21 bp, Homo sapiens
agaggcttaaggaggagaggc

SEQ ID NO: 879 - DNA, 21 bp, Homo sapiens
gaggcttaaggaggagaggca

SEQ ID NO: 880 - DNA, 21 bp, Homo sapiens
aggcttaaggaggagaggcag

SEQ ID NO: 881 - DNA, 21 bp, Homo sapiens
ggcttaaggaggagaggcaga

SEQ ID NO: 882 - DNA, 21 bp, Homo sapiens
gcttaaggaggagaggcagag

SEQ ID NO: 883 - DNA, 21 bp, Homo sapiens
cttaaggaggagaggcagagg

SEQ ID NO: 884 - DNA, 21 bp, Homo sapiens
ttaaggaggagaggcagagga

SEQ ID NO: 885 - DNA, 21 bp, Homo sapiens
taaggaggagaggcagaggac

SEQ ID NO: 886 - DNA, 21 bp, Homo sapiens
aaggaggagaggcagaggaca

SEQ ID NO: 887 - DNA, 21 bp, Homo sapiens
aggaggagaggcagaggacaa

SEQ ID NO: 888 - DNA, 21 bp, Homo sapiens
ggaggagaggcagaggacaag

SEQ ID NO: 889 - DNA, 21 bp, Homo sapiens
gaggagaggcagaggacaagg

SEQ ID NO: 890 - DNA, 21 bp, Homo sapiens
aggagaggcagaggacaagga

SEQ ID NO: 891 - DNA, 21 bp, Homo sapiens
ggagaggcagaggacaaggag

SEQ ID NO: 892 - DNA, 21 bp, Homo sapiens
gagaggcagaggacaaggagg

SEQ ID NO: 893 - DNA, 21 bp, Homo sapiens
agaggcagaggacaaggagga

SEQ ID NO: 894 - DNA, 21 bp, Homo sapiens
gcttaaggaggaggaagaagg

SEQ ID NO: 895 - DNA, 21 bp, Homo sapiens
cttaaggaggaggaagaaggg

SEQ ID NO: 896 - DNA, 21 bp, Homo sapiens
ttaaggaggaggaagaaggga

SEQ ID NO: 897 - DNA, 21 bp, Homo sapiens
taaggaggaggaagaagggag

SEQ ID NO: 898 - DNA, 21 bp, Homo sapiens
aaggaggaggaagaagggagg

SEQ ID NO: 899 - DNA, 21 bp, Homo sapiens
aggaggaggaagaagggagga

SEQ ID NO: 900 - DNA, 21 bp, Homo sapiens
ggaggaggaagaagggaggag

SEQ ID NO: 901 - DNA, 21 bp, Homo sapiens
gaggaggaagaagggaggagg

SEQ ID NO: 902 - DNA, 21 bp, Homo sapiens
aggaggaagaagggaggaggc

SEQ ID NO: 903 - DNA, 21 bp, Homo sapiens
ggaggaagaagggaggaggca

SEQ ID NO: 904 - DNA, 21 bp, Homo sapiens
gaggaagaagggaggaggcag

SEQ ID NO: 905 - DNA, 21 bp, Homo sapiens
aggaagaagggaggaggcaga

SEQ ID NO: 906 - DNA, 21 bp, Homo sapiens
ggaagaagggaggaggcagag

SEQ ID NO: 907 - DNA, 21 bp, Homo sapiens
gaagaagggaggaggcagagg

SEQ ID NO: 908 - DNA, 21 bp, Homo sapiens
aagaagggaggaggcagagga

SEQ ID NO: 909 - DNA, 21 bp, Homo sapiens
agaagggaggaggcagaggac

SEQ ID NO: 910 - DNA, 21 bp, Homo sapiens
gaagggaggaggcagaggaca

SEQ ID NO: 911 - DNA, 21 bp, Homo sapiens
aagggaggaggcagaggacaa

SEQ ID NO: 912 - DNA, 21 bp, Homo sapiens
agggaggaggcagaggacaag

SEQ ID NO: 913 - DNA, 21 bp, Homo sapiens
gggaggaggcagaggacaagg

SEQ ID NO: 914 - DNA, 21 bp, Homo sapiens
gcttaaggaggaggaagaagc

SEQ ID NO: 915 - DNA, 21 bp, Homo sapiens
cttaaggaggaggaagaagcg

SEQ ID NO: 916 - DNA, 21 bp, Homo sapiens
ttaaggaggaggaagaagcgt

SEQ ID NO: 917 - DNA, 21 bp, Homo sapiens
taaggaggaggaagaagcgtt

SEQ ID NO: 918 - DNA, 21 bp, Homo sapiens
aaggaggaggaagaagcgttt

SEQ ID NO: 919 - DNA, 21 bp, Homo sapiens
aggaggaggaagaagcgttta

SEQ ID NO: 920 - DNA, 21 bp, Homo sapiens
ggaggaggaagaagcgtttaa

SEQ ID NO: 921 - DNA, 21 bp, Homo sapiens
gaggaggaagaagcgtttaag

SEQ ID NO: 922 - DNA, 21 bp, Homo sapiens
aggaggaagaagcgtttaaga

SEQ ID NO: 923 - DNA, 21 bp, Homo sapiens
ggaggaagaagcgtttaagag

SEQ ID NO: 924 - DNA, 21 bp, Homo sapiens
gaggaagaagcgtttaagagg

SEQ ID NO: 925 - DNA, 21 bp, Homo sapiens
aggaagaagcgtttaagagga

SEQ ID NO: 926 - DNA, 21 bp, Homo sapiens
ggaagaagcgtttaagaggac

SEQ ID NO: 927 - DNA, 21 bp, Homo sapiens
gaagaagcgtttaagaggaca

SEQ ID NO: 928 - DNA, 21 bp, Homo sapiens
aagaagcgtttaagaggacaa

SEQ ID NO: 929 - DNA, 21 bp, Homo sapiens
agaagcgtttaagaggacaag

SEQ ID NO: 930 - DNA, 21 bp, Homo sapiens
gaagcgtttaagaggacaagg

SEQ ID NO: 931 - DNA, 21 bp, Homo sapiens
aagcgtttaagaggacaagga

SEQ ID NO: 932 - DNA, 21 bp, Homo sapiens
agcgtttaagaggacaaggag

SEQ ID NO: 933 - DNA, 21 bp, Homo sapiens
gcgtttaagaggacaaggagg

SEQ ID NO: 934 - DNA, 21 bp, Homo sapiens
cgtttaagaggacaaggagga

SEQ ID NO: 935 - DNA, 21 bp, Homo sapiens
gtttaagaggacaaggaggat

SEQ ID NO: 936 - DNA, 21 bp, Homo sapiens
tttaagaggacaaggaggatg

SEQ ID NO: 937 - DNA, 21 bp, Homo sapiens
ttaagaggacaaggaggatga

SEQ ID NO: 938 - DNA, 21 bp, Homo sapiens
taagaggacaaggaggatgat

SEQ ID NO: 939 - DNA, 21 bp, Homo sapiens
aagaggacaaggaggatgatg

SEQ ID NO: 940 - DNA, 21 bp, Homo sapiens
ttaaggaggaggaagaagaca

SEQ ID NO: 941 - DNA, 21 bp, Homo sapiens
taaggaggaggaagaagacaa

SEQ ID NO: 942 - DNA, 21 bp, Homo sapiens
aaggaggaggaagaagacaac

SEQ ID NO: 943 - DNA, 21 bp, Homo sapiens
aggaggaggaagaagacaacg

SEQ ID NO: 944 - DNA, 21 bp, Homo sapiens
ggaggaggaagaagacaacgc

SEQ ID NO: 945 - DNA, 21 bp, Homo sapiens
gaggaggaagaagacaacgca

SEQ ID NO: 946 - DNA, 21 bp, Homo sapiens
aggaggaagaagacaacgcaa

SEQ ID NO: 947 - DNA, 21 bp, Homo sapiens
ggaggaagaagacaacgcaaa

SEQ ID NO: 948 - DNA, 21 bp, Homo sapiens
gaggaagaagacaacgcaaag

SEQ ID NO: 949 - DNA, 21 bp, Homo sapiens
aggaagaagacaacgcaaaga

SEQ ID NO: 950 - DNA, 21 bp, Homo sapiens
ggaagaagacaacgcaaagag

SEQ ID NO: 951 - DNA, 21 bp, Homo sapiens
gaagaagacaacgcaaagagg

SEQ ID NO: 952 - DNA, 21 bp, Homo sapiens
aagaagacaacgcaaagagga

SEQ ID NO: 953 - DNA, 21 bp, Homo sapiens
agaagacaacgcaaagaggag

SEQ ID NO: 954 - DNA, 21 bp, Homo sapiens
gaagacaacgcaaagaggagg

SEQ ID NO: 955 - DNA, 21 bp, Homo sapiens
aagacaacgcaaagaggagga

SEQ ID NO: 956 - DNA, 21 bp, Homo sapiens
agacaacgcaaagaggaggag

SEQ ID NO: 957 - DNA, 21 bp, Homo sapiens
gacaacgcaaagaggaggagg

SEQ ID NO: 958 - DNA, 21 bp, Homo sapiens
acaacgcaaagaggaggagga

SEQ ID NO: 959 - DNA, 21 bp, Homo sapiens
caacgcaaagaggaggaggag

SEQ ID NO: 960 - DNA, 21 bp, Homo sapiens
ttaaggaggaggaagaagact

SEQ ID NO: 961 - DNA, 21 bp, Homo sapiens
taaggaggaggaagaagactg

SEQ ID NO: 962 - DNA, 21 bp, Homo sapiens
aaggaggaggaagaagactgc

SEQ ID NO: 963 - DNA, 21 bp, Homo sapiens
aggaggaggaagaagactgcg

SEQ ID NO: 964 - DNA, 21 bp, Homo sapiens
ggaggaggaagaagactgcgt

SEQ ID NO: 965 - DNA, 21 bp, Homo sapiens
gaggaggaagaagactgcgtg

SEQ ID NO: 966 - DNA, 21 bp, Homo sapiens
aggaggaagaagactgcgtga

SEQ ID NO: 967 - DNA, 21 bp, Homo sapiens
ggaggaagaagactgcgtgag

SEQ ID NO: 968 - DNA, 21 bp, Homo sapiens
gaggaagaagactgcgtgagg

SEQ ID NO: 969 - DNA, 21 bp, Homo sapiens
aggaagaagactgcgtgagga

SEQ ID NO: 970 - DNA, 21 bp, Homo sapiens
ggaagaagactgcgtgaggag

SEQ ID NO: 971 - DNA, 21 bp, Homo sapiens
gaagaagactgcgtgaggagg

SEQ ID NO: 972 - DNA, 21 bp, Homo sapiens
aagaagactgcgtgaggagga

SEQ ID NO: 973 - DNA, 21 bp, Homo sapiens
agaagactgcgtgaggaggag

SEQ ID NO: 974 - DNA, 21 bp, Homo sapiens
gaagactgcgtgaggaggagg

SEQ ID NO: 975 - DNA, 21 bp, Homo sapiens
aagactgcgtgaggaggagga

SEQ ID NO: 976 - DNA, 21 bp, Homo sapiens
agactgcgtgaggaggaggag

SEQ ID NO: 977 - DNA, 21 bp, Homo sapiens
gactgcgtgaggaggaggagg

SEQ ID NO: 978 - DNA, 21 bp, Homo sapiens
actgcgtgaggaggaggaggc

SEQ ID NO: 979 - DNA, 21 bp, Homo sapiens
ctgcgtgaggaggaggaggca

SEQ ID NO: 980 - DNA, 21 bp, Homo sapiens
tgcgtgaggaggaggaggcag

SEQ ID NO: 981 - DNA, 21 bp, Homo sapiens
gcgtgaggaggaggaggcaga

SEQ ID NO: 982 - DNA, 21 bp, Homo sapiens
cgtgaggaggaggaggcagag

SEQ ID NO: 983 - DNA, 21 bp, Homo sapiens
gtgaggaggaggaggcagagg

SEQ ID NO: 984 - DNA, 21 bp, Homo sapiens
tgaggaggaggaggcagagga

SEQ ID NO: 985 - DNA, 21 bp, Homo sapiens
ttaaggaggaggaagaagaca

SEQ ID NO: 986 - DNA, 21 bp, Homo sapiens
taaggaggaggaagaagacag

SEQ ID NO: 987 - DNA, 21 bp, Homo sapiens
aaggaggaggaagaagacagg

SEQ ID NO: 988 - DNA, 21 bp, Homo sapiens
aggaggaggaagaagacagga

SEQ ID NO: 989 - DNA, 21 bp, Homo sapiens
ggaggaggaagaagacaggag

SEQ ID NO: 990 - DNA, 21 bp, Homo sapiens
gaggaggaagaagacaggagg

SEQ ID NO: 991 - DNA, 21 bp, Homo sapiens
aggaggaagaagacaggaggc

SEQ ID NO: 992 - DNA, 21 bp, Homo sapiens
ggaggaagaagacaggaggca

SEQ ID NO: 993 - DNA, 21 bp, Homo sapiens
gaggaagaagacaggaggcag

SEQ ID NO: 994 - DNA, 21 bp, Homo sapiens
aggaagaagacaggaggcaga

SEQ ID NO: 995 - DNA, 21 bp, Homo sapiens
ggaagaagacaggaggcagag

SEQ ID NO: 996 - DNA, 21 bp, Homo sapiens
gaagaagacaggaggcagagg

SEQ ID NO: 997 - DNA, 21 bp, Homo sapiens
aagaagacaggaggcagagga

SEQ ID NO: 998 - DNA, 21 bp, Homo sapiens
agaagacaggaggcagaggac

SEQ ID NO: 999 - DNA, 21 bp, Homo sapiens
gaagacaggaggcagaggaca

SEQ ID NO: 1000 - DNA, 21 bp, Homo sapiens
aagacaggaggcagaggacaa

SEQ ID NO: 1001 - DNA, 21 bp, Homo sapiens
agacaggaggcagaggacaag

SEQ ID NO: 1002 - DNA, 21 bp, Homo sapiens
gacaggaggcagaggacaagg

SEQ ID NO: 1003 - DNA, 21 bp, Homo sapiens
acaggaggcagaggacaagga

SEQ ID NO: 1004 - DNA, 21 bp, Homo sapiens
caggaggcagaggacaaggag

SEQ ID NO: 1005 - DNA, 21 bp, Homo sapiens
aaggaggaggaagaagacaaa

SEQ ID NO: 1006 - DNA, 21 bp, Homo sapiens
aggaggaggaagaagacaaaa

SEQ ID NO: 1007 - DNA, 21 bp, Homo sapiens
ggaggaggaagaagacaaaag

SEQ ID NO: 1008 - DNA, 21 bp, Homo sapiens
gaggaggaagaagacaaaagg

SEQ ID NO: 1009 - DNA, 21 bp, Homo sapiens
aggaggaagaagacaaaaggc

SEQ ID NO: 1010 - DNA, 21 bp, Homo sapiens
ggaggaagaagacaaaaggca

SEQ ID NO: 1011 - DNA, 21 bp, Homo sapiens
gaggaagaagacaaaaggcag

SEQ ID NO: 1012 - DNA, 21 bp, Homo sapiens
aggaagaagacaaaaggcaga

SEQ ID NO: 1013 - DNA, 21 bp, Homo sapiens
ggaagaagacaaaaggcagag

SEQ ID NO: 1014 - DNA, 21 bp, Homo sapiens
gaagaagacaaaaggcagagg

SEQ ID NO: 1015 - DNA, 21 bp, Homo sapiens
aagaagacaaaaggcagagga

SEQ ID NO: 1016 - DNA, 21 bp, Homo sapiens
agaagacaaaaggcagaggac

SEQ ID NO: 1017 - DNA, 21 bp, Homo sapiens
gaagacaaaaggcagaggaca

SEQ ID NO: 1018 - DNA, 21 bp, Homo sapiens
aagacaaaaggcagaggacaa

SEQ ID NO: 1019 - DNA, 21 bp, Homo sapiens
agacaaaaggcagaggacaag

SEQ ID NO: 1020 - DNA, 21 bp, Homo sapiens
gacaaaaggcagaggacaagg

SEQ ID NO: 1021 - DNA, 21 bp, Homo sapiens
acaaaaggcagaggacaagga

SEQ ID NO: 1022 - DNA, 21 bp, Homo sapiens
caaaaggcagaggacaaggag

SEQ ID NO: 1023 - DNA, 21 bp, Homo sapiens
aaaaggcagaggacaaggagg

SEQ ID NO: 1024 - DNA, 21 bp, Homo sapiens
aaaggcagaggacaaggagga

SEQ ID NO: 1025 - DNA, 21 bp, Homo sapiens
aaggcagaggacaaggaggat

SEQ ID NO: 1026 - DNA, 21 bp, Homo sapiens
aaggaggaggaagaagacaaa

SEQ ID NO: 1027 - DNA, 21 bp, Homo sapiens
aggaggaggaagaagacaaaa

SEQ ID NO: 1028 - DNA, 21 bp, Homo sapiens
ggaggaggaagaagacaaaaa

SEQ ID NO: 1029 - DNA, 21 bp, Homo sapiens
gaggaggaagaagacaaaaac

SEQ ID NO: 1030 - DNA, 21 bp, Homo sapiens
aggaggaagaagacaaaaacg

SEQ ID NO: 1031 - DNA, 21 bp, Homo sapiens
ggaggaagaagacaaaaacgc

SEQ ID NO: 1032 - DNA, 21 bp, Homo sapiens
gaggaagaagacaaaaacgca

SEQ ID NO: 1033 - DNA, 21 bp, Homo sapiens
aggaagaagacaaaaacgcaa

SEQ ID NO: 1034 - DNA, 21 bp, Homo sapiens
ggaagaagacaaaaacgcaaa

SEQ ID NO: 1035 - DNA, 21 bp, Homo sapiens
gaagaagacaaaaacgcaaag

SEQ ID NO: 1036 - DNA, 21 bp, Homo sapiens
aagaagacaaaaacgcaaaga

SEQ ID NO: 1037 - DNA, 21 bp, Homo sapiens
agaagacaaaaacgcaaagag

SEQ ID NO: 1038 - DNA, 21 bp, Homo sapiens
gaagacaaaaacgcaaagagg

SEQ ID NO: 1039 - DNA, 21 bp, Homo sapiens
aagacaaaaacgcaaagagga

SEQ ID NO: 1040 - DNA, 21 bp, Homo sapiens
agacaaaaacgcaaagaggag

SEQ ID NO: 1041 - DNA, 21 bp, Homo sapiens
gacaaaaacgcaaagaggagg

SEQ ID NO: 1042 - DNA, 21 bp, Homo sapiens
acaaaaacgcaaagaggagga

SEQ ID NO: 1043 - DNA, 21 bp, Homo sapiens
caaaaacgcaaagaggaggag

SEQ ID NO: 1044 - DNA, 21 bp, Homo sapiens
aaaaacgcaaagaggaggagg

SEQ ID NO: 1045 - DNA, 21 bp, Homo sapiens
aaaacgcaaagaggaggagga

SEQ ID NO: 1046 - DNA, 21 bp, Homo sapiens
aaacgcaaagaggaggaggag

SEQ ID NO: 1047 - DNA, 21 bp, Homo sapiens
aggaggaggaagaagacaagt

SEQ ID NO: 1048 - DNA, 21 bp, Homo sapiens
ggaggaggaagaagacaagtg

SEQ ID NO: 1049 - DNA, 21 bp, Homo sapiens
gaggaggaagaagacaagtgt

SEQ ID NO: 1050 - DNA, 21 bp, Homo sapiens
aggaggaagaagacaagtgtt

SEQ ID NO: 1051 - DNA, 21 bp, Homo sapiens
ggaggaagaagacaagtgttt

SEQ ID NO: 1052 - DNA, 21 bp, Homo sapiens
gaggaagaagacaagtgtttc

SEQ ID NO: 1053 - DNA, 21 bp, Homo sapiens
aggaagaagacaagtgtttcg

SEQ ID NO: 1054 - DNA, 21 bp, Homo sapiens
ggaagaagacaagtgtttcgc

SEQ ID NO: 1055 - DNA, 21 bp, Homo sapiens
gaagaagacaagtgtttcgca

SEQ ID NO: 1056 - DNA, 21 bp, Homo sapiens
aagaagacaagtgtttcgcaa

SEQ ID NO: 1057 - DNA, 21 bp, Homo sapiens
agaagacaagtgtttcgcaaa

SEQ ID NO: 1058 - DNA, 21 bp, Homo sapiens
gaagacaagtgtttcgcaaag

SEQ ID NO: 1059 - DNA, 21 bp, Homo sapiens
aagacaagtgtttcgcaaaga

SEQ ID NO: 1060 - DNA, 21 bp, Homo sapiens
agacaagtgtttcgcaaagag

SEQ ID NO: 1061 - DNA, 21 bp, Homo sapiens
gacaagtgtttcgcaaagagg

SEQ ID NO: 1062 - DNA, 21 bp, Homo sapiens
acaagtgtttcgcaaagagga

SEQ ID NO: 1063 - DNA, 21 bp, Homo sapiens
caagtgtttcgcaaagaggag

SEQ ID NO: 1064 - DNA, 21 bp, Homo sapiens
aagtgtttcgcaaagaggagg

SEQ ID NO: 1065 - DNA, 21 bp, Homo sapiens
agtgtttcgcaaagaggagga

SEQ ID NO: 1066 - DNA, 21 bp, Homo sapiens
gtgtttcgcaaagaggaggag

SEQ ID NO: 1067 - DNA, 21 bp, Homo sapiens
tgtttcgcaaagaggaggagg

SEQ ID NO: 1068 - DNA, 21 bp, Homo sapiens
gtttcgcaaagaggaggagga

SEQ ID NO: 1069 - DNA, 21 bp, Homo sapiens
tttcgcaaagaggaggaggag

SEQ ID NO: 1070 - DNA, 21 bp, Homo sapiens
ttcgcaaagaggaggaggagg

SEQ ID NO: 1071 - DNA, 21 bp, Homo sapiens
tcgcaaagaggaggaggaggc

SEQ ID NO: 1072 - DNA, 21 bp, Homo sapiens
gaagaagacaagaaacgcaaa

SEQ ID NO: 1073 - DNA, 21 bp, Homo sapiens
aagaagacaagaaacgcaaaa

SEQ ID NO: 1074 - DNA, 21 bp, Homo sapiens
agaagacaagaaacgcaaaag

SEQ ID NO: 1075 - DNA, 21 bp, Homo sapiens
gaagacaagaaacgcaaaagg

SEQ ID NO: 1076 - DNA, 21 bp, Homo sapiens
aagacaagaaacgcaaaagga

SEQ ID NO: 1077 - DNA, 21 bp, Homo sapiens
agacaagaaacgcaaaaggag

SEQ ID NO: 1078 - DNA, 21 bp, Homo sapiens
gacaagaaacgcaaaaggagg

SEQ ID NO: 1079 - DNA, 21 bp, Homo sapiens
acaagaaacgcaaaaggagga

SEQ ID NO: 1080 - DNA, 21 bp, Homo sapiens
caagaaacgcaaaaggaggat

SEQ ID NO: 1081 - DNA, 21 bp, Homo sapiens
aagaaacgcaaaaggaggatg

SEQ ID NO: 1082 - DNA, 21 bp, Homo sapiens
agaaacgcaaaaggaggatga

SEQ ID NO: 1083 - DNA, 21 bp, Homo sapiens
gaaacgcaaaaggaggatgat

SEQ ID NO: 1084 - DNA, 21 bp, Homo sapiens
aaacgcaaaaggaggatgatg

SEQ ID NO: 1085 - DNA, 21 bp, Homo sapiens
aacgcaaaaggaggatgatga

SEQ ID NO: 1086 - DNA, 21 bp, Homo sapiens
acgcaaaaggaggatgatgag

SEQ ID NO: 1087 - DNA, 21 bp, Homo sapiens
cgcaaaaggaggatgatgagg

SEQ ID NO: 1088 - DNA, 21 bp, Homo sapiens
gcaaaaggaggatgatgagga

SEQ ID NO: 1089 - DNA, 21 bp, Homo sapiens
caaaaggaggatgatgaggac

SEQ ID NO: 1090 - DNA, 21 bp, Homo sapiens
aaaaggaggatgatgaggaca

SEQ ID NO: 1091 - DNA, 21 bp, Homo sapiens
aaaggaggatgatgaggacaa

SEQ ID NO: 1092 - DNA, 21 bp, Homo sapiens
aagacaagaaacgcaaagagc

SEQ ID NO: 1093 - DNA, 21 bp, Homo sapiens
agacaagaaacgcaaagagcc

SEQ ID NO: 1094 - DNA, 21 bp, Homo sapiens
gacaagaaacgcaaagagcct

SEQ ID NO: 1095 - DNA, 21 bp, Homo sapiens
acaagaaacgcaaagagcctc

SEQ ID NO: 1096 - DNA, 21 bp, Homo sapiens
caagaaacgcaaagagcctcc

SEQ ID NO: 1097 - DNA, 21 bp, Homo sapiens
aagaaacgcaaagagcctcct

SEQ ID NO: 1098 - DNA, 21 bp, Homo sapiens
agaaacgcaaagagcctcctc

SEQ ID NO: 1099 - DNA, 21 bp, Homo sapiens
gaaacgcaaagagcctcctct

SEQ ID NO: 1100 - DNA, 21 bp, Homo sapiens
aaacgcaaagagcctcctctt

SEQ ID NO: 1101 - DNA, 21 bp, Homo sapiens
aacgcaaagagcctcctcttt

SEQ ID NO: 1102 - DNA, 21 bp, Homo sapiens
acgcaaagagcctcctctttg

SEQ ID NO: 1103 - DNA, 21 bp, Homo sapiens
cgcaaagagcctcctctttgt

SEQ ID NO: 1104 - DNA, 21 bp, Homo sapiens
gcaaagagcctcctctttgtc

SEQ ID NO: 1105 - DNA, 21 bp, Homo sapiens
caaagagcctcctctttgtct

SEQ ID NO: 1106 - DNA, 21 bp, Homo sapiens
aaagagcctcctctttgtcta

SEQ ID NO: 1107 - DNA, 21 bp, Homo sapiens
aagagcctcctctttgtctaa

SEQ ID NO: 1108 - DNA, 21 bp, Homo sapiens
agagcctcctctttgtctaag

SEQ ID NO: 1109 - DNA, 21 bp, Homo sapiens
gagcctcctctttgtctaagg

SEQ ID NO: 1110 - DNA, 21 bp, Homo sapiens
agcctcctctttgtctaagga

SEQ ID NO: 1111 - DNA, 21 bp, Homo sapiens
gcctcctctttgtctaaggag

SEQ ID NO: 1112 - DNA, 21 bp, Homo sapiens
cctcctctttgtctaaggagg

SEQ ID NO: 1113 - DNA, 21 bp, Homo sapiens
ctcctctttgtctaaggagga

SEQ ID NO: 1114 - DNA, 21 bp, Homo sapiens
tcctctttgtctaaggaggat

SEQ ID NO: 1115 - DNA, 21 bp, Homo sapiens
cctctttgtctaaggaggatg

SEQ ID NO: 1116 - DNA, 21 bp, Homo sapiens
ctctttgtctaaggaggatga

SEQ ID NO: 1117 - DNA, 21 bp, Homo sapiens
tctttgtctaaggaggatgat

SEQ ID NO: 1118 - DNA, 21 bp, Homo sapiens
ctttgtctaaggaggatgatg

SEQ ID NO: 1119 - DNA, 21 bp, Homo sapiens
tttgtctaaggaggatgatga

SEQ ID NO: 1120 - DNA, 21 bp, Homo sapiens
ttgtctaaggaggatgatgag

SEQ ID NO: 1121 - DNA, 21 bp, Homo sapiens
tgtctaaggaggatgatgagg

SEQ ID NO: 1122 - DNA, 21 bp, Homo sapiens
gtctaaggaggatgatgagga

SEQ ID NO: 1123 - DNA, 21 bp, Homo sapiens
tctaaggaggatgatgaggac

SEQ ID NO: 1124 - DNA, 21 bp, Homo sapiens
ctaaggaggatgatgaggaca

SEQ ID NO: 1125 - DNA, 21 bp, Homo sapiens
taaggaggatgatgaggacaa

SEQ ID NO: 1126 - DNA, 21 bp, Homo sapiens
gacaagaaacgcaaagaggac

SEQ ID NO: 1127 - DNA, 21 bp, Homo sapiens
acaagaaacgcaaagaggacc

SEQ ID NO: 1128 - DNA, 21 bp, Homo sapiens
caagaaacgcaaagaggacca

SEQ ID NO: 1129 - DNA, 21 bp, Homo sapiens
aagaaacgcaaagaggaccat

SEQ ID NO: 1130 - DNA, 21 bp, Homo sapiens
agaaacgcaaagaggaccatc

SEQ ID NO: 1131 - DNA, 21 bp, Homo sapiens
gaaacgcaaagaggaccatcc

SEQ ID NO: 1132 - DNA, 21 bp, Homo sapiens
aaacgcaaagaggaccatcct

SEQ ID NO: 1133 - DNA, 21 bp, Homo sapiens
aacgcaaagaggaccatcctt

SEQ ID NO: 1134 - DNA, 21 bp, Homo sapiens
acgcaaagaggaccatccttg

SEQ ID NO: 1135 - DNA, 21 bp, Homo sapiens
cgcaaagaggaccatccttgt

SEQ ID NO: 1136 - DNA, 21 bp, Homo sapiens
gcaaagaggaccatccttgtc

SEQ ID NO: 1137 - DNA, 21 bp, Homo sapiens
caaagaggaccatccttgtcg

SEQ ID NO: 1138 - DNA, 21 bp, Homo sapiens
aaagaggaccatccttgtcgg

SEQ ID NO: 1139 - DNA, 21 bp, Homo sapiens
aagaggaccatccttgtcgga

SEQ ID NO: 1140 - DNA, 21 bp, Homo sapiens
agaggaccatccttgtcggag

SEQ ID NO: 1141 - DNA, 21 bp, Homo sapiens
gaggaccatccttgtcggagg

SEQ ID NO: 1142 - DNA, 21 bp, Homo sapiens
aggaccatccttgtcggagga

SEQ ID NO: 1143 - DNA, 21 bp, Homo sapiens
ggaccatccttgtcggaggat

SEQ ID NO: 1144 - DNA, 21 bp, Homo sapiens
gaccatccttgtcggaggatg

SEQ ID NO: 1145 - DNA, 21 bp, Homo sapiens
accatccttgtcggaggatga

SEQ ID NO: 1146 - DNA, 21 bp, Homo sapiens
ccatccttgtcggaggatgat

SEQ ID NO: 1147 - DNA, 21 bp, Homo sapiens
catccttgtcggaggatgatg

SEQ ID NO: 1148 - DNA, 21 bp, Homo sapiens
atccttgtcggaggatgatga

SEQ ID NO: 1149 - DNA, 21 bp, Homo sapiens
tccttgtcggaggatgatgag

SEQ ID NO: 1150 - DNA, 21 bp, Homo sapiens
ccttgtcggaggatgatgagg

SEQ ID NO: 1151 - DNA, 21 bp, Homo sapiens
cttgtcggaggatgatgagga

SEQ ID NO: 1152 - DNA, 21 bp, Homo sapiens
ttgtcggaggatgatgaggac

SEQ ID NO: 1153 - DNA, 21 bp, Homo sapiens
tgtcggaggatgatgaggaca

SEQ ID NO: 1154 - DNA, 21 bp, Homo sapiens
gtcggaggatgatgaggacaa

SEQ ID NO: 1155 - DNA, 21 bp, Homo sapiens
tcggaggatgatgaggacaaa

SEQ ID NO: 1156 - DNA, 21 bp, Homo sapiens
cggaggatgatgaggacaaag

SEQ ID NO: 1157 - DNA, 21 bp, Homo sapiens
agaggaggaggaggcagaggg

SEQ ID NO: 1158 - DNA, 21 bp, Homo sapiens
gaggaggaggaggcagagggc

SEQ ID NO: 1159 - DNA, 21 bp, Homo sapiens
aggaggaggaggcagagggca

SEQ ID NO: 1160 - DNA, 21 bp, Homo sapiens
ggaggaggaggcagagggcaa

SEQ ID NO: 1161 - DNA, 21 bp, Homo sapiens
gaggaggaggcagagggcaat

SEQ ID NO: 1162 - DNA, 21 bp, Homo sapiens
aggaggaggcagagggcaatt

SEQ ID NO: 1163 - DNA, 21 bp, Homo sapiens
ggaggaggcagagggcaattg

SEQ ID NO: 1164 - DNA, 21 bp, Homo sapiens
gaggaggcagagggcaattgt

SEQ ID NO: 1165 - DNA, 21 bp, Homo sapiens
aggaggcagagggcaattgtc

SEQ ID NO: 1166 - DNA, 21 bp, Homo sapiens
ggaggcagagggcaattgtcg

SEQ ID NO: 1167 - DNA, 21 bp, Homo sapiens
gaggcagagggcaattgtcgg

SEQ ID NO: 1168 - DNA, 21 bp, Homo sapiens
aggcagagggcaattgtcgga

SEQ ID NO: 1169 - DNA, 21 bp, Homo sapiens
ggcagagggcaattgtcggag

SEQ ID NO: 1170 - DNA, 21 bp, Homo sapiens
gcagagggcaattgtcggagg

SEQ ID NO: 1171 - DNA, 21 bp, Homo sapiens
cagagggcaattgtcggagga

SEQ ID NO: 1172 - DNA, 21 bp, Homo sapiens
agagggcaattgtcggaggat

SEQ ID NO: 1173 - DNA, 21 bp, Homo sapiens
gagggcaattgtcggaggatg

SEQ ID NO: 1174 - DNA, 21 bp, Homo sapiens
agggcaattgtcggaggatga

SEQ ID NO: 1175 - DNA, 21 bp, Homo sapiens
gggcaattgtcggaggatgat

SEQ ID NO: 1176 - DNA, 21 bp, Homo sapiens
ggcaattgtcggaggatgatg

SEQ ID NO: 1177 - DNA, 21 bp, Homo sapiens
gcaattgtcggaggatgatga

SEQ ID NO: 1178 - DNA, 21 bp, Homo sapiens
caattgtcggaggatgatgag

SEQ ID NO: 1179 - DNA, 21 bp, Homo sapiens
aattgtcggaggatgatgagg

SEQ ID NO: 1180 - DNA, 21 bp, Homo sapiens
attgtcggaggatgatgagga

SEQ ID NO: 1181 - DNA, 21 bp, Homo sapiens
ttgtcggaggatgatgaggac

SEQ ID NO: 1182 - DNA, 21 bp, Homo sapiens
tgtcggaggatgatgaggaca

SEQ ID NO: 1183 - DNA, 21 bp, Homo sapiens
gtcggaggatgatgaggacaa

SEQ ID NO: 1184 - DNA, 21 bp, Homo sapiens
tcggaggatgatgaggacaaa

SEQ ID NO: 1185 - DNA, 21 bp, Homo sapiens
cggaggatgatgaggacaaag

SEQ ID NO: 1186 - DNA, 21 bp, Homo sapiens
aggaggaggaggcagaggact

SEQ ID NO: 1187 - DNA, 21 bp, Homo sapiens
ggaggaggaggcagaggactg

SEQ ID NO: 1188 - DNA, 21 bp, Homo sapiens
gaggaggaggcagaggactgt

SEQ ID NO: 1189 - DNA, 21 bp, Homo sapiens
aggaggaggcagaggactgtc

SEQ ID NO: 1190 - DNA, 21 bp, Homo sapiens
ggaggaggcagaggactgtcg

SEQ ID NO: 1191 - DNA, 21 bp, Homo sapiens
gaggaggcagaggactgtcgg

SEQ ID NO: 1192 - DNA, 21 bp, Homo sapiens
aggaggcagaggactgtcgga

SEQ ID NO: 1193 - DNA, 21 bp, Homo sapiens
ggaggcagaggactgtcggag

SEQ ID NO: 1194 - DNA, 21 bp, Homo sapiens
gaggcagaggactgtcggagg

SEQ ID NO: 1195 - DNA, 21 bp, Homo sapiens
aggcagaggactgtcggagga

SEQ ID NO: 1196 - DNA, 21 bp, Homo sapiens
ggcagaggactgtcggaggat

SEQ ID NO: 1197 - DNA, 21 bp, Homo sapiens
gcagaggactgtcggaggatg

SEQ ID NO: 1198 - DNA, 21 bp, Homo sapiens
cagaggactgtcggaggatga

SEQ ID NO: 1199 - DNA, 21 bp, Homo sapiens
agaggactgtcggaggatgat

SEQ ID NO: 1200 - DNA, 21 bp, Homo sapiens
gaggactgtcggaggatgatg

SEQ ID NO: 1201 - DNA, 21 bp, Homo sapiens
aggactgtcggaggatgatga

SEQ ID NO: 1202 - DNA, 21 bp, Homo sapiens
ggactgtcggaggatgatgag

SEQ ID NO: 1203 - DNA, 21 bp, Homo sapiens
gactgtcggaggatgatgagg

SEQ ID NO: 1204 - DNA, 21 bp, Homo sapiens
actgtcggaggatgatgagga

SEQ ID NO: 1205 - DNA, 21 bp, Homo sapiens
ctgtcggaggatgatgaggac

SEQ ID NO: 1206 - DNA, 21 bp, Homo sapiens
tgtcggaggatgatgaggaca

SEQ ID NO: 1207 - DNA, 21 bp, Homo sapiens
gtcggaggatgatgaggacaa

SEQ ID NO: 1208 - DNA, 21 bp, Homo sapiens
tcggaggatgatgaggacaaa

SEQ ID NO: 1209 - DNA, 21 bp, Homo sapiens
cggaggatgatgaggacaaag

SEQ ID NO: 1210 - DNA, 21 bp, Homo sapiens
gaggaggaggcagaggacaaa

SEQ ID NO: 1211 - DNA, 21 bp, Homo sapiens
aggaggaggcagaggacaaat

SEQ ID NO: 1212 - DNA, 21 bp, Homo sapiens
ggaggaggcagaggacaaatg

SEQ ID NO: 1213 - DNA, 21 bp, Homo sapiens
gaggaggcagaggacaaatgt

SEQ ID NO: 1214 - DNA, 21 bp, Homo sapiens
aggaggcagaggacaaatgtc

SEQ ID NO: 1215 - DNA, 21 bp, Homo sapiens
ggaggcagaggacaaatgtcg

SEQ ID NO: 1216 - DNA, 21 bp, Homo sapiens
gaggcagaggacaaatgtcgg

SEQ ID NO: 1217 - DNA, 21 bp, Homo sapiens
aggcagaggacaaatgtcgga

SEQ ID NO: 1218 - DNA, 21 bp, Homo sapiens
ggcagaggacaaatgtcggag

SEQ ID NO: 1219 - DNA, 21 bp, Homo sapiens
gcagaggacaaatgtcggagg

SEQ ID NO: 1220 - DNA, 21 bp, Homo sapiens
cagaggacaaatgtcggagga

SEQ ID NO: 1221 - DNA, 21 bp, Homo sapiens
agaggacaaatgtcggaggat

SEQ ID NO: 1222 - DNA, 21 bp, Homo sapiens
gaggacaaatgtcggaggatg

SEQ ID NO: 1223 - DNA, 21 bp, Homo sapiens
aggacaaatgtcggaggatga

SEQ ID NO: 1224 - DNA, 21 bp, Homo sapiens
ggacaaatgtcggaggatgat

SEQ ID NO: 1225 - DNA, 21 bp, Homo sapiens
gacaaatgtcggaggatgatg

SEQ ID NO: 1226 - DNA, 21 bp, Homo sapiens
acaaatgtcggaggatgatga

SEQ ID NO: 1227 - DNA, 21 bp, Homo sapiens
caaatgtcggaggatgatgag

SEQ ID NO: 1228 - DNA, 21 bp, Homo sapiens
aaatgtcggaggatgatgagg

SEQ ID NO: 1229 - DNA, 21 bp, Homo sapiens
aatgtcggaggatgatgagga

SEQ ID NO: 1230 - DNA, 21 bp, Homo sapiens
atgtcggaggatgatgaggac

SEQ ID NO: 1231 - DNA, 21 bp, Homo sapiens
tgtcggaggatgatgaggaca

SEQ ID NO: 1232 - DNA, 21 bp, Homo sapiens
gtcggaggatgatgaggacaa

SEQ ID NO: 1233 - DNA, 21 bp, Homo sapiens
tcggaggatgatgaggacaaa

SEQ ID NO: 1234 - DNA, 21 bp, Homo sapiens
cggaggatgatgaggacaaag

SEQ ID NO: 1235 - DNA, 21 bp, Homo sapiens
ggaggaggaggcagaggacac

SEQ ID NO: 1236 - DNA, 21 bp, Homo sapiens
gaggaggaggcagaggacact

SEQ ID NO: 1237 - DNA, 21 bp, Homo sapiens
aggaggaggcagaggacactt

SEQ ID NO: 1238 - DNA, 21 bp, Homo sapiens
ggaggaggcagaggacacttg

SEQ ID NO: 1239 - DNA, 21 bp, Homo sapiens
gaggaggcagaggacacttgt

SEQ ID NO: 1240 - DNA, 21 bp, Homo sapiens
aggaggcagaggacacttgtc

SEQ ID NO: 1241 - DNA, 21 bp, Homo sapiens
ggaggcagaggacacttgtcg

SEQ ID NO: 1242 - DNA, 21 bp, Homo sapiens
gaggcagaggacacttgtcgg

SEQ ID NO: 1243 - DNA, 21 bp, Homo sapiens
aggcagaggacacttgtcgga

SEQ ID NO: 1244 - DNA, 21 bp, Homo sapiens
ggcagaggacacttgtcggag

SEQ ID NO: 1245 - DNA, 21 bp, Homo sapiens
gcagaggacacttgtcggagg

SEQ ID NO: 1246 - DNA, 21 bp, Homo sapiens
cagaggacacttgtcggagga

SEQ ID NO: 1247 - DNA, 21 bp, Homo sapiens
agaggacacttgtcggaggat

SEQ ID NO: 1248 - DNA, 21 bp, Homo sapiens
gaggacacttgtcggaggatg

SEQ ID NO: 1249 - DNA, 21 bp, Homo sapiens
aggacacttgtcggaggatga

SEQ ID NO: 1250 - DNA, 21 bp, Homo sapiens
ggacacttgtcggaggatgat

SEQ ID NO: 1251 - DNA, 21 bp, Homo sapiens
gacacttgtcggaggatgatg

SEQ ID NO: 1252 - DNA, 21 bp, Homo sapiens
acacttgtcggaggatgatga

SEQ ID NO: 1253 - DNA, 21 bp, Homo sapiens
cacttgtcggaggatgatgag

SEQ ID NO: 1254 - DNA, 21 bp, Homo sapiens
acttgtcggaggatgatgagg

SEQ ID NO: 1255 - DNA, 21 bp, Homo sapiens
cttgtcggaggatgatgagga

SEQ ID NO: 1256 - DNA, 21 bp, Homo sapiens
ttgtcggaggatgatgaggac

SEQ ID NO: 1257 - DNA, 21 bp, Homo sapiens
tgtcggaggatgatgaggaca

SEQ ID NO: 1258 - DNA, 21 bp, Homo sapiens
gtcggaggatgatgaggacaa

SEQ ID NO: 1259 - DNA, 21 bp, Homo sapiens
tcggaggatgatgaggacaaa

SEQ ID NO: 1260 - DNA, 21 bp, Homo sapiens
cggaggatgatgaggacaaag

SEQ ID NO: 1261 - DNA, 21 bp, Homo sapiens
ggaggaggaggcagaggacat

SEQ ID NO: 1262 - DNA, 21 bp, Homo sapiens
gaggaggaggcagaggacatt

SEQ ID NO: 1263 - DNA, 21 bp, Homo sapiens
aggaggaggcagaggacattt

SEQ ID NO: 1264 - DNA, 21 bp, Homo sapiens
ggaggaggcagaggacatttg

SEQ ID NO: 1265 - DNA, 21 bp, Homo sapiens
gaggaggcagaggacatttgt

SEQ ID NO: 1266 - DNA, 21 bp, Homo sapiens
aggaggcagaggacatttgtc

SEQ ID NO: 1267 - DNA, 21 bp, Homo sapiens
ggaggcagaggacatttgtcg

SEQ ID NO: 1268 - DNA, 21 bp, Homo sapiens
gaggcagaggacatttgtcgg

SEQ ID NO: 1269 - DNA, 21 bp, Homo sapiens
aggcagaggacatttgtcgga

SEQ ID NO: 1270 - DNA, 21 bp, Homo sapiens
ggcagaggacatttgtcggag

SEQ ID NO: 1271 - DNA, 21 bp, Homo sapiens
gcagaggacatttgtcggagg

SEQ ID NO: 1272 - DNA, 21 bp, Homo sapiens
cagaggacatttgtcggagga

SEQ ID NO: 1273 - DNA, 21 bp, Homo sapiens
agaggacatttgtcggaggat

SEQ ID NO: 1274 - DNA, 21 bp, Homo sapiens
gaggacatttgtcggaggatg

SEQ ID NO: 1275 - DNA, 21 bp, Homo sapiens
aggacatttgtcggaggatga

SEQ ID NO: 1276 - DNA, 21 bp, Homo sapiens
ggacatttgtcggaggatgat

SEQ ID NO: 1277 - DNA, 21 bp, Homo sapiens
gacatttgtcggaggatgatg

SEQ ID NO: 1278 - DNA, 21 bp, Homo sapiens
acatttgtcggaggatgatga

SEQ ID NO: 1279 - DNA, 21 bp, Homo sapiens
catttgtcggaggatgatgag

SEQ ID NO: 1280 - DNA, 21 bp, Homo sapiens
atttgtcggaggatgatgagg

SEQ ID NO: 1281 - DNA, 21 bp, Homo sapiens
tttgtcggaggatgatgagga

SEQ ID NO: 1282 - DNA, 21 bp, Homo sapiens
ttgtcggaggatgatgaggac

SEQ ID NO: 1283 - DNA, 21 bp, Homo sapiens
tgtcggaggatgatgaggaca

SEQ ID NO: 1284 - DNA, 21 bp, Homo sapiens
gtcggaggatgatgaggacaa

SEQ ID NO: 1285 - DNA, 21 bp, Homo sapiens
tcggaggatgatgaggacaaa

SEQ ID NO: 1286 - DNA, 21 bp, Homo sapiens
cggaggatgatgaggacaaag

SEQ ID NO: 1287 - DNA, 21 bp, Homo sapiens
ggaggaggcagaggacaagtg

SEQ ID NO: 1288 - DNA, 21 bp, Homo sapiens
gaggaggcagaggacaagtgt

SEQ ID NO: 1289 - DNA, 21 bp, Homo sapiens
aggaggcagaggacaagtgtc

SEQ ID NO: 1290 - DNA, 21 bp, Homo sapiens
ggaggcagaggacaagtgtcg

SEQ ID NO: 1291 - DNA, 21 bp, Homo sapiens
gaggcagaggacaagtgtcgg

SEQ ID NO: 1292 - DNA, 21 bp, Homo sapiens
aggcagaggacaagtgtcgga

SEQ ID NO: 1293 - DNA, 21 bp, Homo sapiens
ggcagaggacaagtgtcggag

SEQ ID NO: 1294 - DNA, 21 bp, Homo sapiens
gcagaggacaagtgtcggagg

SEQ ID NO: 1295 - DNA, 21 bp, Homo sapiens
cagaggacaagtgtcggagga

SEQ ID NO: 1296 - DNA, 21 bp, Homo sapiens
agaggacaagtgtcggaggat

SEQ ID NO: 1297 - DNA, 21 bp, Homo sapiens
gaggacaagtgtcggaggatg

SEQ ID NO: 1298 - DNA, 21 bp, Homo sapiens
aggacaagtgtcggaggatga

SEQ ID NO: 1299 - DNA, 21 bp, Homo sapiens
ggacaagtgtcggaggatgat

SEQ ID NO: 1300 - DNA, 21 bp, Homo sapiens
gacaagtgtcggaggatgatg

SEQ ID NO: 1301 - DNA, 21 bp, Homo sapiens
acaagtgtcggaggatgatga

SEQ ID NO: 1302 - DNA, 21 bp, Homo sapiens
caagtgtcggaggatgatgag

SEQ ID NO: 1303 - DNA, 21 bp, Homo sapiens
aagtgtcggaggatgatgagg

SEQ ID NO: 1304 - DNA, 21 bp, Homo sapiens
agtgtcggaggatgatgagga

SEQ ID NO: 1305 - DNA, 21 bp, Homo sapiens
gtgtcggaggatgatgaggac

SEQ ID NO: 1306 - DNA, 21 bp, Homo sapiens
tgtcggaggatgatgaggaca

SEQ ID NO: 1307 - DNA, 21 bp, Homo sapiens
gtcggaggatgatgaggacaa

SEQ ID NO: 1308 - DNA, 21 bp, Homo sapiens
tcggaggatgatgaggacaaa

SEQ ID NO: 1309 - DNA, 21 bp, Homo sapiens
cggaggatgatgaggacaaag

SEQ ID NO: 1310 - DNA, 20 bp, Artificial Sequence
  Description of Artificial Sequence: Synthetic forward primer
gtcaggttggtttgagaggc

SEQ ID NO: 1311 - DNA, 19 bp, Artificial Sequence
  Description of Artificial Sequence: Synthetic reverse primer
gctaaccctaactcccgcc

SEQ ID NO: 1312 - DNA, 20 bp, Artificial Sequence
  Description of Artificial Sequence: Synthetic forward primer
ggatctcctttcctgtcccc

SEQ ID NO: 1313 - DNA, 19 bp, Artificial Sequence
  Description of Artificial Sequence: Synthetic reverse primer
ccacctgtcctcctccaag

SEQ ID NO: 1314 - DNA, 20 bp, Artificial Sequence
  Description of Artificial Sequence: Synthetic forward primer
gaggacaggtggaggaagtg

SEQ ID NO: 1315 - DNA, 22 bp, Artificial Sequence
  Description of Artificial Sequence: Synthetic reverse primer
aaattgttgctgggacttattc

SEQ ID NO: 1316 - DNA, 20 bp, Artificial Sequence
  Description of Artificial Sequence: Synthetic forward primer
cagacccgagttgaagaacc

SEQ ID NO: 1317 - DNA, 20 bp, Artificial Sequence
  Description of Artificial Sequence: Synthetic reverse primer
agaaggaagaaggtgagcgg

SEQ ID NO: 1318 - DNA, 20 bp, Artificial Sequence
  Description of Artificial Sequence: Synthetic forward primer
ctgatcaacaaggacatccg

SEQ ID NO: 1319 - DNA, 20 bp, Artificial Sequence
  Description of Artificial Sequence: Synthetic reverse primer
ctcgggcttcttagcatcag

SEQ ID NO: 1320 - DNA, 20 bp, Artificial Sequence
  Description of Artificial Sequence: Synthetic forward primer
aagcctgaggttggtgtttg

SEQ ID NO: 1321 - DNA, 19 bp, Artificial Sequence
  Description of Artificial Sequence: Synthetic reverse primer
ctcacctggggtgcctacc

SEQ ID NO: 1322 - DNA, 19 bp, Artificial Sequence
  Description of Artificial Sequence: Synthetic forward primer
gtgtcagcggtgttccttg

SEQ ID NO: 1323 - DNA, 20 bp, Artificial Sequence
  Description of Artificial Sequence: Synthetic reverse primer
ttaagcctctgctcctcgtc

SEQ ID NO: 1324 - DNA, 77 bp, Homo sapiens
cgaggagcagaggcttaaggaggaggaagaagacaagaaacgcatagaggaggaggaggcagaggacaaggaggatg

SEQ ID NO: 1325 - DNA, 78 bp, Homo sapiens
cgaggagcagaggacaaggaggatgatgaggacaaagatgaggatgaggaggatgaggaggacaaggaggaagatgag

SEQ ID NO: 1326 - DNA, 79 bp, Homo sapiens
aggacgaggagcagaggcttaaggaggaggaagaagacaagaaacgcaaagaggaggaggaggcagaggacaaggagga

SEQ ID NO: 1327 - DNA, 79 bp, Homo sapiens
aggacgaggagcagaggcttaaggaggaggaagaagacaaaaacgcaaagaggaggaggaggcagaggacaaggaggat

SEQ ID NO: 1328 - DNA, 17 bp, Homo sapiens
gcagcagagaaacaaat

SEQ ID NO: 1329 - DNA, 15 bp, Homo sapiens
aaggacgagctgtag

SEQ ID NO: 1330 - protein, 5 aa, Homo sapiens
AAEKQ

SEQ ID NO: 1331 - protein, 4 aa, Homo sapiens
KDEL

SEQ ID NO: 1332 - protein, 5 aa, Homo sapiens
QQRNK

SEQ ID NO: 1333 - protein, 4 aa, Homo sapiens
RTSC

SEQ ID NO: 1334 - protein, 5 aa, Homo sapiens
SRETN

SEQ ID NO: 1335 - protein, 4 aa, Homo sapiens
GRAV

SEQ ID NO: 1336 - DNA, 10 bp, Homo sapiens
aggaggaggg

SEQ ID NO: 1337 - DNA, 11 bp, Homo sapiens
gaggaggcagt

SEQ ID NO: 1338 - DNA, 14 bp, Homo sapiens
cctcctctttgtct

SEQ ID NO: 1339 - DNA, 11 bp, Homo sapiens
ccatccttgtc

SEQ ID NO: 1340 - DNA, 29 bp, Artificial Sequence
  Description of Artificial Sequence: Synthetic forward primer
gtttcttagtgcatctttattatggcaga

SEQ ID NO: 1341 - DNA, 20 bp, Artificial Sequence
  Description of Artificial Sequence: Synthetic reverse primer
ttactctcgtctccacagac

SEQ ID NO: 1342 - DNA, 23 bp, Artificial Sequence
  Description of Artificial Sequence: Synthetic reverse primer
aaattactctcgtctccacagaa

SEQ ID NO: 1343 - DNA, 27 bp, Artificial Sequence
  Description of Artificial Sequence: Synthetic forward primer
gtttcttccgaagtctgaccctttttg

SEQ ID NO: 1344 - DNA, 20 bp, Artificial Sequence
  Description of Artificial Sequence: Synthetic reverse primer
gtagtgtgcaggaaactgcc

SEQ ID NO: 1345 - DNA, 23 bp, Artificial Sequence
  Description of Artificial Sequence: Synthetic reverse primer
aaagtagtgtgcaggaaactgca

SEQ ID NO: 1346 - DNA, 45 bp, Artificial Sequence
  Description of Artificial Sequence: Synthetic primer
atgcctcgagccgccaccatgctgctatccgtgccgctgctgctc

SEQ ID NO: 1347 - DNA, 34 bp, Artificial Sequence
  Description of Artificial Sequence: Synthetic primer
atgcgaattcctacagctcgtccttggcctggcc

SEQ ID NO: 1348 - DNA, 36 bp, Artificial Sequence
  Description of Artificial Sequence: Synthetic primer
cctcatcatcctccttgtcctctgctcctcgtcctg

SEQ ID NO: 1349 - DNA, 36 bp, Artificial Sequence
  Description of Artificial Sequence: Synthetic primer
caggacgaggagcagaggacaaggaggatgatgagg

SEQ ID NO: 1350 - DNA, 35 bp, Artificial Sequence
  Description of Artificial Sequence: Synthetic primer
atgcccgcggctaggcctcagtccagccctggagg

We claim:

1. A method of treating a myeloid malignancy, comprising:
   a. obtaining and analyzing a sample from a patient; wherein the analyzing is selected from:
      (i) sequencing a nucleic acid or protein;
      (ii) determining the size of a nucleic acid fragment or a protein fragment; and
      (iii) hybridizing to a nucleic acid; and
      (iv) binding of an antibody to CALR protein or fragment;
   b. detecting the presence or absence of one or more mutant alleles in exon 9 of calreticulin (CALR), and
   c. wherein if no mutant allele in exon 9 of CALR is detected, further analyzing the sample for the presence or absence of a mutation selected from
      (i) a mutation in JAK2 V617F,
      (ii) a mutation in exon 12 of JAK2, and
      (iii) a mutation in exon 10 of MPL; and
   d. wherein, where a patient is determined to have a mutation identified in (b) or (c) the patient is administered an effective amount of a therapeutic agent.

2. The method of claim 1, wherein the mutant allele in exon 9 of the CALR gene comprise a sequence selected from the group consisting of SEQ ID NOs 440 to 475.

3. The method of claim 1, wherein the analyzing further comprises amplification of DNA with primers selected from
   (a) The pair of SEQ ID NO: 437 and SEQ ID NO: 438; or
   (b) The pair of SEQ ID NO: 439 and SEQ ID NO: 438.

4. The method of claim 1, wherein the mutant CALR comprises the nucleic acid of SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, 143, 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, 287, 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432 or 433.

5. The method of claim 1, wherein the mutant CALR protein comprises the amino acid sequence of SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 224, 228, 232, 236, 240, 244, 248, 252, 256, 260, 264, 268, 272, 276, 280, 284, 288, 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, or 434.

6. The method of claim 1, wherein said analysing comprises hybridization of a nucleic acid from the same sample to a sequence selected from SEQ ID NO: 2, 6, 10, 14, 18, 22, 26, 30, 34, 38, 42, 46, 50, 54, 58, 62, 66, 70, 74, 78, 82, 86, 90, 94, 98, 102, 106, 110, 114, 118, 122, 126, 130, 134, 138, 142, 146, 150, 154, 158, 162, 166, 170, 174, 178, 182, 186, 190, 194, 198, 202, 206, 210, 214, 218, 222, 226, 230, 234, 238, 242, 246, 250, 254, 258, 262, 266, 270, 274, 278, 282, or 286; 292, 296, 300, 304, 308, 312, 316, 320, 324, 328, 332, 336, 340, 344, 348, 352, 356, 360, 364, 368, 372, 376, 380, 384, 388, 392, 396, 400, 404, 408, 412, 416, 420, 424, 428, or 432.

7. The method of claim 1, wherein said sample is a bone marrow sample.

8. The method of claim 1, wherein said sample is a blood sample.

9. The method of claim 1, wherein said patient is a human patient.

10. The method of claim 1, wherein said myeloid malignancy is a myeloproliferative neoplasm or myelodysplastic syndrome.

11. The method of claim 1, wherein said myeloid malignancy is primary myelofibrosis (PMF).

12. The method of claim 1, wherein said myeloid malignancy is essential thrombocythemia (ET).

13. The method of claim 1, wherein said wherein said myeloid malignancy is refractory anemia with ringed sideroblasts and thrombocythemia (RARS-T).

14. The method of claim 1, further comprising analyzing the sample for the presence or absence of a mutation selected from JAK2 V617F, a mutation in exon 12 of JAK2, and a mutation in exon 10 of MPL.

15. The method of claim 14 wherein the patient does not have a JAK2 V617F mutation.

16. The method of claim 14, wherein the patient does not have a mutation in exon 12 of JAK2.

17. The method of claim 14, wherein the patient does not have a mutation in exon 10 of MPL.

18. The method of claim 1, wherein said hybridizing to a nucleic acid is high-resolution melting.

19. The method of claim 1, wherein said binding of an antibody is immunohistochemistry.

20. The method of claim 1, wherein said nucleic acid is mRNA, and said analyzing comprises RealTime PCR, ReverseTranscriptase PCR, Whole Transcriptome Shotgun Sequencing (RNAseq), in situ hybridization or micro-arrays.

21. The method according to claim 20, wherein the determination by RealTime PCR or ReverseTranscriptase PCR further comprises the steps
  (i) contacting the nucleic acid in the sample with one or two oligonucleotides:
  (ii) generating an amplification product containing the target sequence.

22. The method of claim 1, wherein the analyzing is immunohistochemistry (IHC), by immunoassay, gel- or blot-based methods, IHC, mass spectrometry, flow cytometry, or FACS on a protein.

23. The method of claim 1, further comprising treating the patient with hydroxyurea and/or interferon alpha.

24. The method of claim 1, further comprising treating the patient with an antibody against JAK.

25. The method of claim 1, further comprising treating the patient with an antibody that binds to a mutant variant of CALR.

26. The method of claim 1, wherein the analyzing comprises hybridization to at least one primer that further comprises a detectable label.

27. The method of claim 26, wherein the detectable label is 6-carboxyfluorescein (6-FAM).

28. The method of claim 1, wherein the analyzing comprises hybridization to a primer that is 10-30 nucleotides in length.

29. The method of claim 27, wherein the analyzing comprises hybridization to a primer that is at least 90% identical to a sequence in the nucleic acid selected from the group consisting of SEQ ID NO: 1, 2, 3, 5, 6, 7, 9, 10, 11, 13, 14, 15, 17, 18, 19, 21, 22, 23, 25, 26, 27, 29, 30, 31, 33, 34, 35, 37, 38, 39, 41, 42, 43, 45, 46, 47, 49, 50, 51, 53, 54, 55, 57, 58, 59, 61, 62, 63, 65, 66, 67, 69, 70, 71, 73, 74, 75, 77, 78, 79, 81, 82, 83, 85, 86, 87, 89, 90, 91, 93, 94, 95, 97, 98, 99, 101, 102, 103, 105, 106, 107, 109, 110, 111, 113, 114, 115, 117, 118, 119, 121, 122, 123, 125, 126, 127, 129, 130, 131, 133, 134, 135, 137, 138, 139, 141, 142, 143, 145, 146, 147, 149, 150, 151, 153, 154, 155, 157, 158, 159, 161, 162, 163, 165, 166, 167, 169, 170, 171, 173, 174, 175, 177, 178, 179, 181, 182, 183, 185, 186, 187, 189, 190, 191, 193, 194, 195, 197, 198, 199, 201, 202, 203, 205, 206, 207, 209, 210, 211, 213, 214, 215, 217, 218, 219, 221, 222, 223, 225, 226, 227, 229, 230, 231, 233, 234, 235, 237, 238, 239, 241, 242, 243, 245, 246, 247, 249, 250, 251, 253, 254, 255, 257, 258, 259, 261, 262, 263, 265, 266, 267, 269, 270, 271, 273, 274, 275, 277, 278, 279, 281, 282, 283, 285, 286, 287, 291, 292, 293, 295, 296, 297, 299, 300, 301, 303, 304, 305, 307, 308, 309, 311, 312, 313, 315, 316, 317, 319, 320, 321, 323, 324, 325, 327, 328, 329, 331, 332, 333, 335, 336, 337, 339, 340, 341, 343, 344, 345, 347, 348, 349, 351, 352, 353, 355, 356, 357, 359, 360, 361, 363, 364, 365, 367, 368, 369, 371, 372, 373, 375, 376, 377, 379, 380, 381, 383, 384, 385, 387, 388, 389, 391, 392, 393, 395, 396, 397, 399, 400, 401, 403, 404, 405, 407, 408, 409, 411, 412, 413, 415, 416, 417, 419, 420, 421, 423, 424, 425, 427, 428, 429, 431, 432, and 433.

30. The method of claim 1, wherein the therapeutic agent is mutant calreticulin.

* * * * *